United States Patent 11,180,807 (METHODS FOR DETECTING A GENETIC VARIATION IN ATTRACTIN-LIKE 1 (ATRNL1) GENE IN SUBJECT WITH PARKINSON'S DISEASE) - sequence listing, part 11

SEQ ID NO: 189 - DNA, 5441170 bp, Homo sapiens (residues 1,813,725-3,627,448 of 5,441,170)
  misc_feature (895456)..(945455): n is a, c, g, or t
  misc_feature (1206566)..(1256565): n is a, c, g, or t
  misc_feature (1464799)..(1514798): n is a, c, g, or t
  misc_feature (1657604)..(1707603): n is a, c, g, or t
  misc_feature (2172111)..(2222110): n is a, c, g, or t
  misc_feature (2374984)..(2424983): n is a, c, g, or t
  misc_feature (2597563)..(2647562): n is a, c, g, or t
  misc_feature (3845721)..(3895720): n is a, c, g, or t
  misc_feature (4445464)..(4495463): n is a, c, g, or t
  misc_feature (5128335)..(5178334): n is a, c, g, or t
aaaaatatcagatcaaatcagagaaaataaatgaattcaatctaccactctaaaatactgcagaggcaatgttaaattactttattaagcaaaccaagaaaaaataaattatatatgatttgtattattttttaacttccacactatttaatggtataagattctctttcaatgctttcaatgaaataggtatcttactttcacttagaacatttttttcaaagtaattcttaaaattctgtttttctaataggtttgcagcaataggtagcaattattattattagaaacatacccagatgctttcttctcggcgatactgcttccagtttctcccaccatcactgaacatcaggaggtagctggtcacccagtcagagctcccatatcctccttgggtggcgacagcagtgacctccattctctctccaaggtcaatttgcagccattggtatttatttgacacaagtggggtccagccaccagctccttttttgaaatagaaaaagtataaaaatggtagaggaggaagttatttaacatagctgttactagattagaaaactataaaattatgaatatatattaagaaaatcatcgatttacaatagaaaaaatagaataattacatgtgactggatgaaccctaaattgtgttcacatttagctagatgacccctgatattctagaaggcaggtgtcccactgactgcagaaaatgtttgtttaatgcaggtggccactagagcattcctgtcaacttttggaactagtgttatttcatagcccttgtgcaagatttgccctttgccaacataagagactaaattccagtagtaggaagtacagcattaagcactgataaaacaaagacggttaatatattgaccttgcactcaaagtgcttacagtctcataggagaaatggatgtaaaagaagagttaaaacatagagtgctttgtgaggcaatcccacttacatgtggaattctaaaaagttgatttcacaaaagtacagaggagagtgatggttaagaggaactggggtgtggaggagatattggtaaaaaaatacaaaaaggtatggagtagcaaatggtcaaggtgagtcctaagcaggttctggtgcactctgctctctctggcagtactgcagggaaactggggcaagcctcacacagcgctcatccaccttggacaaggaaaaggagactgttgggtattgaagaagatgcatgcagagcagaaaatttgctctttttgctctgaccaatgccacatctgaaacaaaaacataggcatgtccgctgatgttttattgatgtttgttatttttctagtctaatagaattaggggacactcgaaaaccacagcttctttaataatcaatgtctagaaaaagagagtgctctataaactattcccaagctgaggagtcagaacacttttattattccctggtgctgccacttacctgaaggctctgacagaaattctgaagttctagacagttcattattattcattgacttatactgtgtattttattattaggagtttatcattatgtcctcatttgtaaagtctttagtacttcactacatgtccaaaaaagtttgatattattagaatatagctaggtgtaaaaacgaataagtgaggacattatactttaatataagttattatggggaagtgttgagaaatataaatattaggcacctatttgaattgatgaccacacttaactactgtttccttatgattcccaagtttacagattcttagaagtcagattctaagatatttttgtagtgaatctttgttcaaaaatattttttcctctgaatgtatgataagcacctctaaagtttatattatatatatagtatgtacacagacatatatatagatataatttttgtttgttttgctttttattgttctatgttctgaattgaagagtcaggaatttgatctagtagacaagatggaaaattactgataaccaacactgtgcatctgattgacactaaaatactccatatattttcttaatccagacagctaggaggtggacacagctcttgttcaaagttaaatgttctgctatagaccaggggcatcctccactcatgcaacatggtttcctagatcgggcaagatttattcttggatgatttacagcaatatttatgtgagcccctgccagagacagtgcccagatttctttagccctcagtaggaactacttccacagtttcttctctctgctcattcctccttccaacttaacttttcaggatgtaacagaattccacgtacccacttccataatcattcaatttaacaatgaacacttatcgagcatttgagaactctaggtcaggcaaagagttccctttaagtaaattttgcatttaattcctaacatacctttaaaagacaaggcctcattactaccctccatatggatggtgggcagctcacctatgtttacgcatctagcaaggggcccacaagctttggatccagaacctgtgcaattaaatatttttattatattattttgatgataatcatgggatgtggtgtttctcaaataaatgtaacaaagatgtaaagacatttgggagtgagcaggtctggctacctaaggcagcagcccccatgcagcagggcaacctctcctactcctggtcaggcaaggtctgggttttggaaagctgagggtgcagtgccaatggggttttctctactggcccttcctgttgactccaccagatctactcttctctcctaagcctatgtaaactttaattggtgggagatccttttggggttggtctaactagcaaccaatggtcctaggtacaacactactgaaactgtgtatccttttctgtttttcttattactattttaaggggttttgttttgttttgttttgtttttgtttttttttgagatggagtctcactctgtcaccagcctggagtgcagtggcgagatctctgctcactgcaacctccaactccctggttcaagcaattctcctgcctcagccacccaagtagccgggattacaggtacatgccaccacacccagctaatttttgtatttttagtagagacggggtttcaccacgttggccaggatggtcttggtctcctgacctagtgatttgcccacctcagcctcccaaagtgctgggattacaggcatgagccactgggcccagcctattttatggttgttttaaaagagttgggagaaggtgaaggagatgctaacagccaacccatcatcttaggctggatgttgtacattgggaattttatacacagagctgaaacttctgaggaactattcaatatttttggttcttcccctcatcttggttagtcagcatgaagggcatcctcttcagcttgtatttcataacctttctttggtgttttcactccctctcattccaggtttagaaaagtaattactatgagaacacatgtggagaagcacaaggaggaaaatgagttgacacggttctggtgtgctaccctgggatggtgtgttttcattagatgaagagggagccactggccatccctcttctcggcatccctcacagtttgttagtttgttggtgttcatggttgcactcctgctaacagatgacacatttcagtgatttcattttacctttgatgaagtagtactcaaatgcaaataagctatattttcagccattactgataaagtaatgaaattctggcattaccaaagaatttcatcaggatgttgtagcctcatggttacaatctgcaatcccagatgcgttttaagggtaagctgctgtgcacacaatttaattaaacgctgagtggaaatggtgggaaacacagcgtgactgacctgtgcactgctggatagcactagtctgtgtgcctttgttaaaggcagctttgatggttggtatagaaggccactatgggtaacagaaagagaaaggaggttggctgactccacccccaactagagtgtggtaattgtccactcactcagcctctctgagacaaaaatgttgtcctttgtttaaaaaagaaaagcataaagttgggagggggggattaacagtcatataaatcacctcacaagactgtaaggaagacaatgggataactgaaactacagcactttgtaactaaattattattcaaatgtgatgttatactcaatttttgttgtctttaaattaaaacaaatgaaagtcttctatttgttaagtcaagattatacatgtgctgactaattttcaacctggaagtgtcttttcatagtcccttctagtctatggtcaacaaaactttgtacacaaaacaggggaagcagttaggtcctctaagctcagcctctcccccataacaaatgtttcttctccacttcaccctcctccccctgcctctgacaagacattgcacctgagttaaataaagtgtcacaattctaccccacagatcctatgaatcacgaaaactcatcccctccattcataatatatgttctgacacacatgttccattactggaatgagattaaaatatgctgagcaactgaaactttctcttacactttatatggcttgaggaacagcagatgttattttttaaagggtaattcgtttttataaaggctgatattggtaccacagtgaagatgctgagctgcgctgttttgtccctaaatgttcacacaacataggttttatcttatgtaccgttttatccacttttaagttttcaagttctgaggaaattattaaagttttgccacttattttgtaatggaaaacaagggaaaagggggaagtgagaaactgtgaagcatatattgtatgctgagaattcgaccagatattttcaagcatattatcattttttatttctaaaagcattcagtgggttgtctttatcgtatctaccttacagatgagaaaataaaatcactaattaaaacacatggaaagatattatttttaaaatcagctatgtttcatttttatccttgtccatgaatatattcacatgatttgtcaatcacttagtactttttggttataaataatctggcaggattatgtctctattttgtacagttatatctgtgttataattctgcatttacatcaggtcaaagttacatttcactatctggggcagggggctctgcaaaagaaaagtagaaaccctacagctggagcctgaattgtttctgactaacaacaataaaacttcccatgactatagcatctagtcattaagtggcagcactgttacagagtatgtattgactttgtttacaggggaaataatgcacaggtaaatcatcatcatcatcattacgattatcatcatatcaccataatcttataccttccttaactaaatttgatattgagggcacaaaatataagtaaacaaagtaaatgttcaaagccagccactattaggggcttctatatatcaagcaaacacacagttaagtcaaccttgtccccatgagacacttcccactaagataacaaattgtttcaaatgtgattttatccagatatatttgtttgtttctttcctcatctaattgcattttaattcacattaaaaatttcaggtattacctggggtgagcaggaggtgggaagtgagacgtgaggtagggactgtcacagctcctacactccagtgtgattatatgtaatttatagggaagaggagtgaagctggctttaaataaactccctcattccacttctgagatttataggctttaaacagccatgctttttgtcagtagatctgcctttttgctgaggggaatttaaacatttacctgagatctaatttcatttagaaaaaaaagggctaactacacagatatagaatcaggtaccacagtctttttcaactaggctgctttaaagtaaaaaaatacagaaaccctccctcagaatctgtctttgtgtacatgttctatttcagcagtatttccttcaatcttagcaggttgaagcagaaagaatattcagcctactaaaaatgtgttcataaaaaaagaactgcaattatggttaaaatctcagagtgtatataacaatttataaaatgtattctcttacaaaatgcatctacactccctagcagctttgaaaatggacaaagaataaacaaaaaacaaatagtagatgttagacttaaaattaatcatataaacaaccatattaaaggtaagtagtgcaaacactcttattaaatggcaatgatggtcagattagatgagaaagtaagatccaactatatgttgcctacaagaaacacactttaaataaaaaaggctcaaatagcctaagtgtaaacacatggaaaaatatatattatgctaataatagtttttaaaaaagctggattggctatattaaacaaagtatatttcagtgcaaaaattattataaaaggtaaagaaaattattttgtaatgattaagatgttctttcatcagagaacataatcctaaacatgcaaacacttaataacagagcttcaaaatacacgaaatgaaatctagtaaaactgaatgaaatagataaatccacaatgacagtaggagattctagcaccccgtctcagtaactgattgcacaagaagacagaaaatagggattcagaagtattaattatcactatcaacctatatgattcattgatatttatggaatgtttcacctaacagaagaacatgtattctttttcgagttcatttggaacttttaccaaaatagaccattaaacgagtcattaaacaagtttcaacaaagttaaaatcatttaagtcatgtaaagtatatctttgtgatatacaatagattaaaataagaaatcagcaatagcaacttctctgaaaaatccaggaatattaggaaactaataacacatacttcatactcaatgaatcaaagaagaaactaaaagggaaattagcaagtatttcaagctgaatgaaaatgaaaatacaacttatcaaaatctatgggctggaacttctggcttctgccccaggaagtagaaagctataaggagcctcatttccacccttacaacaaacttcaagttcatgatcttttacaaatgcattggagagttgagcttgcagaaccaccacctggcctaaaatctaaagagatatgaacctcgcagggagagatgtgagcaggagctcaccttagatagatgaaaccagaggtcagtaagaaaagttcagctggaatagttaacaaaatggtgaaacctactgtgcaggctggtgggacagtgagaaatcctttatcaccccagaagttgggggagtgttccctcttgcaggcacttgctccacaggccattggcagaaactcacatgcagtccactgagaactctatttggccctcacagaaaatatcagaaagagccctaaaggttaaataactcagcctataacctcccttatctccacatcttgatttttgcataggtgtagttccattcatcttggtaactaactgcataatttaataaaaccatcattgtgcattttttcattcatccaataaagtatctgatgagacatataatctcaaattatcacttgagcaggcaaagaagccattatcttcacttggtgagtagaaacaattaggcaaaagtgatgggtgatgtgcaaatggggcatatgaggagagggctggaatggagtcagggcaccctgaggctgacggcacgcctctcattgtgttccatttcccacagatagtgtgtttactttcttcagggagtgattaaacacgtgtatttgtctttcttattaaatgacaattgatgtcatgcaaggaaacacgagagtgaaatgctgagaagtgaatattttagtgaatatcaaattatccatctgtatgtgattgattgctcagtcaaccaaaatcccctagtccaccccctaaaaaaaaagagatggtaatatttacatttttcctaaggatattatgtagttaaactaattatagtttatgaaattgctgttaaagcctcatatgaagagagacatgcatttattattgcatgtaacaggacactatcaaaatatgatgcaaaaggaatgtcctctaaacattacaataatgtttattttaagttgctattaacagaggaatttttttagaggcaagcacacaacagggacaatgtggggcatcagaattctgctaacgtttgtcccactgaattctttggaaaaaatatgacaacctaaaaaaatccagttggcaaaaattaatgtgaaagaaaataggtgaatctgcaccatgtcctatagaagttctggaatgcctcccttaacactgactttaataactaatgtaggagagttggttataggaccaattgttgtaatttaccattttcatcattggtcatagtccttttgaatcagttttgaagcacaaattaaactgccagtcagaatttaaatgttatttaagaaaaaaattattttgaaatacagcttcacatgaattggcaaagacagtacagagaagtgatgtgtactcttcacctagtttctaccagtggttacatcttataaaattacagtacaatatcaaaaccaggaaacgatgtatctatccagttgtatgacacgtttagggtccgtaacccccaccacaatcaagaaagagaatgacttcactaccacgacaatcctcctcattggtaccctttacagttatacatagcaaccactaatttgttttctatctctataatttcctcaattcctcaggttcctagatggtctgtcttccctacattttttcattcttatgtttattttatatataaagtgccttttaaaatgtacttatcaggaagaatatattaaagacatgtacttcatctctccggagcagaagctggcaatatgatggtgaatacagtgtccctttattcttgagtgattccagttgcctctggtaaacaggaagtttcctattcaacctcacctttcttgccaagaactgcatgacagttgagctgtcacatgtatcactggatttttttgaacaggaaaaaagtgaaaggacaacatttttagaaggaagaacgcaaactgtaagagagtgatgcgaaaatcctagagaggagtgggacggcattcttcattaagagtaattggtaacattaagcaacaattaagtacataaagaaatcatggcctatcagtagctttaattttattactaaatagcaaccagttcaacgaatatgccacattgtggttatccattcagtggctgatggacatttgagttgtttccagtttttgtctactgtattagtccattttcacactgctgatgaagacatatctgagactgggtaattcataaagaaaaaaggtttaatggattcacatttccatgtggctgaggaggcctcacaatcatggcagaaggcgaaaagcatattttacgtggcagcaaacaagagagaatgactatcaagcaaaagggggtcccccttataaaaccgtcagaccttgtgagattgattctcaactacgagaacagtatgggggaaaccgcccccatgattcagttatctcccactgggtccctcccacaacacctaggaattatgagagctacaattcaagatgagatctgagtggggacacagccaaaccatatcatctactatgaataatgttgctatgaatatatatatatatataaatttttttttacattttttacatttttgcatttacattttttttttttacattttacaacaggcggagtctcgctctgttgcccaggccaagattcaatgcaatctcagctcactgcaacctccacctcccaggttcaagcgattctcctgcctcagctacccgagtagctaggattcctggtgtgcaccaccacgtccagctaatttttgtatttttagtggacacggggtttcgccatgttggccaggctggtctcaaactcctgacctcaagtaatccacccacctcgccctctcaaactggcggcattacaggtgtgagccactgtgcccagcctctatgaacatttaagtcttagagtggacatacattttttggagtggaattgctaggttatatggtaagtacatgcttttactttttaagaaactgccaaactattctccaaggtggtggcaccatttacattcccaccaacaaagtatgacaattaggattattacaattaggacaattccagtttcttccaatctataaacatagtgtgtctctcaatttatttgagtcttctttattttctaatagctatgttttatagtgttccatgaacaggtcctgcacacctttcgtaagatctacatttaagtattttatttttaatgctattgtgaatgaaattcttttcttaatttgataatcagattgttactactacataaaaaagaattgatttttgtatattaaccttgtatcctgttaacttactaaaattcacttattagttggtgtcttttagatttctagatttcttagaagatctccatataggaacatgttatccatacacaataatgtatggagagacagtccactttaagcagcttgcactcctacatgttttgttgggtctgctaagactacaaaggcctaaaagctcttttatggacccttttttcatggttgtttatgcagctggtaaccttgagaggtgaggttacattttcttccacacaaagagccttctcacttactacttgctataactgcagtagattccccaagctcattatttctcagctgcaatacaagtctgctatgagtgtaatattcatacgtgccctattgcattgaccctgtgggcctcaggggcaaaggagacagatacaaataagctgaaactcatgttgttgtttgtggtgccatgagtaatatagttcacaggtgttgccattctttaattttagccatcctagagaacatattatctctctatgatattaacttatatttctctaatggttaatgattttaataccaaatgttgaccaggataagaagcaactggaattgacacacattggcaatgggagtataacatgttcaagggcttttgaaaatagtttgacagtttctttagagtttcacatactgaaattccactcccaaaagcgatgtaaaataatgtttgtagaaatttattcataatagatccatactggaaacaagccacaagtgtccattttaaaaagaatggataaacaaacagcacaattgaaatctactcagcaatagaaggaaatgtgccacaaatccacgcaacaacatggatggatctcagaaaccttatgctccctaaagggagctggatacaaaagcttctgtatgattctggtactgtatgactttttgtaagttcaaaagcacaagccaacctaaataatatgacagaaagtagaacagtgataggtgggaggtgcctagataatcaataaaaagtattaacaaatggtaagggggtgatgaactgatctgtaacttgatctgggctctggtaatacaggcgtatacatctgtaaatattaaccaaatggcacactttatgcatttaattgtattttaagttatgcctcaatttcaaaaattttaaaaataatttttaaagtgacccaagagaatcagaccagccaaatatttcttgttctcatgtctaatctgtattaacatccttatgaatattttgtttgtttgaatgccacttcctgtcatagtactaacaacctattttagatgaattttaaagttacatatgctgctgaagcatactctttgcgtaagtaagattaatttctttaaaatctacatatttcttcaaccgaaacacattttgctatagataacctgatgctattttgtttggcctgtagtcagctgaatcattcaacatttgtaacatattcacattgtcatatgctacaaatctgaggaaaaaaaagcataaaaatagaatgccattggacttactaattctaagaactattaaaaggcacagataaaaaatttagtaaacaatatcctcaggcaaaatattttctgttgtattaatgttctacttttcaggtcctttgttgcatatgtaaattggcacatctaacacctaggcacattgggaagcttagtgtagcttctgacctataaactaaggaggcgaatatgcaagaattttgattttatgaaaaatgaggaccaggagtggtggctcacacctgtaatcccagcactttggaaggccaaggtgggcgaatcccctgaggccaggagttggagaccagcctggtaaacatggtgaaaccccatttgtaccagaagatataaaaatcagccgggcctggtggtgggtgcttgtaatctcagctacttgggacaagggtaatcccagctgttcagggaaagggaaagggagaaaggggaaaagggaaaaagggtgaaagggggaaaggagaaagaaggggaaaagggaggggaggggaggggagaagaaaaatgtaggggaatttaattcttattagattagttatcttaaatatttgctacatttacattattctatcagagattgatactctttatatttttaaattattgcatacatttttatcaatttctttcctctagattcctcatacaaaacaatgaaatctcacatcctattctgttttgggatattgcactgtgcagaatagtggaaatttcaagtagttaaagatcgcatactataacaaaccatttatgggtcatttccccaatgtaagaattttgcttttatttattaatatgattttaaactatggtgccaagttttcattaggacttatactttctaatgtgggaaataaatatcttgatattgaaaagcccttacaaatatcctgagctattcattttgtattaaaaatattcagtaattattttctctgcctcttaatcactgaacctattcagtgtgccaagaaagcatgatcacatggaaggacatctgaatagtggagaaatatgaggagtggagggaaaagatccaatatgtttccatttgctctgtgtttgcagtttatcacataggtttctaaattatccttgtctatgaaattcattcccatacaccaacgttaatttccattcaaacccacgggcttgctccctgattgtactctgcacgtgagagttcatggttttcaatatatacagcccgtttgaatcattaacgcttctggctgagaatgagagttaacacaagcactttctaaaaacagaaaaagagggcaaaatacatatacgcttttgcctagccagtttcaatttgcttctagcaaaattatccatttcatccctactcctgcacttctatttcacattaacgaaggagaatatgtacttattaaaatggaaagttgtctcacataaaatgctactgagccaatccaatgaatgttcgcaattaaaggtataataatcataaaaagaagaaaacttgataagcaaaagaataatcaagtactagcgtgagttactaagtgttttatttcttaagcttttgtctaaataactttggatcacatagttttcttaaggagacacttaagaagaatgacaaatggagctctactttttctttatttgccttttcttgtatcaaatgccccatcatattttagaaatcttggttttgcagaaaaatttagcaatgtgcaattccaggaaatatcaatgtaaacttaatgacaacaaagtcaggtttaatagtcaaatccaaatttcaagaatttcatattttatataatggcaccaattttcctgtagctgaatatacacaatctgactatacctatatgtcagtatacatacatatatatactgaaatatatatgtatgtatatactgacatatatagtcagtatatgactatgactatagtcagtatatatgactatgactatatatagtcagtatacagttagtatacactaacatatatgtatatgtgtatatgtactgacatatatgtgtgtttatatgcacacacactgaccatgtatgtactgacatatgtgtgtgtgtgtatatatatatatatatatacacacactcacactgaccgtatatatgtatatattcctgcaactgaatacacacacacacacacacacatacattcagcttcaggaaaactggtgccattacataaaatataaagttcttgaaatttggatttgactattaagtacacactgactctctctaaatatatatatatatatacacacacacacacacacacacatatagtatatatttagtacatagtacatacacacacacagatatatacatacatgtgtatttatgtacatttattgaacacattaaaatctattaatttgcaaaattatatatacaaaattaatcatacacttgtgatgaaccttttcattctttcatgtttctttgcatgaagaagtaagagagttgtttggatattagagtggaagagtatacatacataatcagaaatttccagaggaaacatgaagagatgtcaactatttctccattttttattgataatgctttccagaatcatgacttttgatttttgttgtgctataattactcgctctttacaatgtccacttacttccttgagggatatgacaggaagattgagaaaaactgtggctggaaggccggcagtgctgtagagaccctgggacctgggcccttcttctttggctccaggtcatcctgtggtctccccaccttcctcctgcttccctgggccctcctcacaacacttcacagacttctgtcctcgtcttgttgcaacatcttttctaaaatgtattttacaataatttctctacatttcctaagcatctgaaacgtagtgtgacaatttcatatatattaatactttaaactatacaattcctcattctggtttaggaaaaattacaaatcagtttaaaactattttggcaagcaatctaaattaactacagaatatcttcttattgctttcctgtaataggaaagaggtggcgatgagatggtacacaggtaatcctttatgaaagctatggaattcagggcattgctaattcttactaaaatatgtggaaacttagcaactttgagcatcataaaaaataaataggaaggtacatggaagaaaaaccatgttctctaaaaccccataaagctaagttttctaaatataatgaaatgtaaaattttttaaaaatctgacttttttctggtttattttcctttttaatttttaatttttgtgggtatgtagtagttgtatgtatttatagggtacatgagatattttgatacaggcatgtaatacataataatcacatcatagagactggggtatctgacttaagcagcttttgtactggaccacacttaaaatagtttaaagctaaaataatggtatacaaagaattatcagcacagtcaacaatcatcatcatcatcatcatcattttccgttttttcaatctgaaccaaagggagattgttatatctactgacaaatacaaaaatcaaatgggattatgagaatggtcctgtgtcagctagttataaatagaaaatacacatatatatcctattggaaggaaaatacacatatacacacatcacccaaatggtgatgttttacaacacgttatgtataaaattaggcataaaactgaactttaattttcagtgaagtatgaataaaatagtgaagagctctccaggttgacaattataggaacaattctaaaactactcatcagctgattgggactccttataaaattaatttaaatgcaccaaaagccatattgcatttatactgtagaaggtaaaactggtacagccatttcataaaaagatttttgatattttcctgtttttttaaattgaataattgtgacacagagaatgagaaatgcattaatcttattcttagaggtttctctgtcgagtttaagttgccaatgtcatatgcctggcagtgtggtggccaatttaaatggaaccataggggattcattcagtccatgtaaactacttaaacatcacctgacggtcccctcccctgcaccgtgggctgccataacctaatttaacaagctctttcagagtttggacatttctttggtaacaactgacattacctggcattatttcatgttttattctgaattattctactacagaagcttaagtttaattccatctatacatattatttaatgtttgctttgtcatggctctgagctagatgttgtgaaacaatgtgcttaactgccacttttactcccactgttgatactactaattgccgggcgcggtggctcacgcctgtaatcccagcactttgggaggccaaggtggccgaggcggatcacgaggtcaggagttgagcctggccaacatggtgaaaccccgtctctactaaaaatacaaaaaattagccaggcgtggtggcgcgcacctgtaatcccagttactcagaaggctgaggcaggagaatagcttgaacccaggaagcggaggttgcagtcagccgagatcacgtcactgcactccagcctgggtgacagggtgaggctccatctcaaaaaccaaaacaaaacaaaacaaattaaaaaaaaagctactaattataatttttgcttcagcagcactcagtagattttagctactttggatcagatcatatactaattttttaattatggtaatacacatcacatgaaatttaccatttgaactgttttatatgtaaagttcagtagcattaagtacattcacattgtgcaaccatcactaccatccatctctagagctgtttcaccttcccaaatgaaaactctgaacccactaacaataacctccattaccagcccctggcaaccactattctatttcttgtctctatgaatttcactactctaggtacctcatataaatgaataacgtagtagttgtccttttgtgtctagcttattttccttagcataatgtcttgaaagttcatctgtgttacagtacgggccagaattttcttcctacactgcactaggcttctccgtttgtccatcaatggaaatttgggttgtttctcttttggctcttgtggatacacctgctctgaacattgatgtaacataacctaattattttatgtgtattaattcatttaatcttcacaacctattttactcaagttaactgtttcatgataggtactttactaatcccattttataactgaggaaacaaaaactcagggagataaaggaatttgtccaaagttacacagctagtaaggggtagagcctggatgattccaagcttatccctaatcactaaggataagatagcacccttccttcaaggaagttagaattgcacaaagtgtaagaaaagcatacaaacacctagtaagcacacaggcatgtgataaatgctgagagctttttaagggaaagtgccagacatatttagcatgtaggcttagtaaaaatctagattaggtctggcagccaaaatctagattatgacctgctttatatagccagagaactaagaatggttttacatttgtaaagcgttgcatttaaaaaaaaaaaacaaagagggtgggggctgggtatggtggctcaggcctgtaatcccaacattttgggacgctgaggtggctggactgcttgagcccaggaattcaagaccagcctgagcaacataatgagatcccatctttacaaaaaatataaatgttcgctgggtgttatgacatgtgactgtggtcccagctactcgggaggctggggtgggaggatcacctgagcccacggaggttgaggctacactaagctgtgatcttgccactgtactccaaacctgggcaacagagcaagactgtgtttcagaaaaagaaagagaaagagagaagaggggaaaagaaaaaaagagggaaggaaaaaagcaaggaaggaaggaaggagaaggaggaggaagggagggagggagggagggagggaagacagagaaagaaaaaagaaaaaaaagaaatgtaacagagaccttacatggtccacaataccaaaatcattttccatctgtctctttacagcagaagtttgctaactcccatgtttaacttttatttttaattgatgaataataattgtacatttttatgaggtgcaatgtgatgtttggatacatgcatacactgtaaaatgatcgaatcaggctaatcaacatatcagtcacctcaaatatgtatcattcttttagcggtgagaatagttaaaattctctcatatatttcaaaacagacaacacttattaactctattcactatgctgtgcaaaagaacaacagaaattattattcctatctacccaaaactatgtacctactgaccaacatctcccccttccctatccaccctctcctctagcgtctggtaaccaccattctactctctacttctgtgagcactgtctttaaattccacatgtaagtgagactatatggtatttgtctctctgtgcctggtttatttcacttaacataatgtcctccaggttcatccatgttatcacaagtgtcagagttccctgcatcacgggttttaactcacacctttgatgtacttggctctagtaagtacaagcgtggggaaaatgtaaaactcttttggtgcaagcattctgcatcatgtttcagactttcaaagaaaattttaagtcatcctcaacaacatctcattaatttgaggctagagaagatactgactataaccctgacaaaagccacttgagcaaatccgtcagaatcattctgcaggtataaatttttaaatcacaaactcatgagggaaaatgtaacttcatttctccataacccagaaagctttctagtaggagctggaattctggctgatacagagactggaagtagtcacaacaggtgtctctgtccagttaagggataagcctgtcagttcgtgtctgtattggtcgcagacccttgaaaattccttcaggggttcttttacttccccttcatccccagagttaactctggtctcttctggctttgctaattgccttggtaaagcggggaggggagtgtgttcaagccccaagtagaagtcagcactgcactgtcctcagggatggcgacctgctgccgacggagccaagtcctcccatcccaggctgggacagtgctctccacaacgttttgatgaacctttctcctccctctgccagacctcaggcaggaacatggtcttgctcacctgcctttggtacctcagggtgtccttggataactggggctgtcctcaccggccaccagagctgccacagggcatccagtcctgtcactgaatgtgccgcagcacaatgaggatgccgtgcaggctgctcttggagactggcgttctcctttccactacacacttgagagcgcccactcagatccctgagcttcagtgaagacttctattaagccaccaccggcaaggctctgcttgagagcagagcttcagggcagtccccacctctctatgcatcctatcgtgcagtcctgctgagggttcctagtctgcgagatagcagaaaaattaaaacacctttagcctactcaattccctttcaaactttttctacctcagaccaaaagatgcttttggacttcagaagtgaagattaatgtcttggttcacagtctctgcaatgatccccttttctctacacagaagactcaagacaatctgagttaggagcaaagacggaggtctgagggcactggcgaaaaatttcagtgagcttggaagcagggtcatttatgttaattgtacatgtcatcccacacagaaatggcctttataggaattatcagtgtcgtgaagaaagtttttatttccatttttaaacctcatatccccccatcaaaagctcccatcatgagtttctggctgacttacgccaggactcacagaatgattcatccctacatgaaaaagtattttcaccagcctcaaaggttttcaggaattactagatcaaagaattgttaaagaaactttccaaaagctcattctacttgcccctccaagcaaaatactaactttgtgatggattttagacattcctagtccgtaacagtggcatgaaactttttttttttttaatagagacagggttttgatgttgcccaggctggtctccaactcctgggctcaaggtgatccaaccgcctcagcctcccaaagtgctgggattacaggcgtgaaccaacgtgcccggtcccgcacagaagtttttgatgttaggtgtgccaccttcaacgatggctgtgtggatccaatatctgcttctctttcattcataaaatttaccaagttcacattggaaaacattattctatggttattccagaaaatattagattatcaccgttttgtttgaaaactgacggaaaatatgacatcatgttcccatctggcaggagtgcacagcaggcatggaaaatggggatgagtgcgtccaagttagttccaattttcaaacattcgtcccgcaccgcctgttcagttgcctgggtaaaactgccccacgcagagaagcttttaccccaggttaataaagatgctttttatatttgtatttgagttgtggtcactagcaatgttttctagtccagattgtgaaatttgtatttgttactatctttgtttttatacctcaaagaaccatttagagtcactgattcatttccataaagcaggaactttccaaaatttagtaagaatagctaagtacaaatctaaaaaaaaaattacatacttcaaaaactaaaaatgcattcactgagatgccttatatcctaattaaatattagctgaattgtaattgatcttacattttgattttgtgaaatatatattgcctttactccaaaatttactagaccaccttcttacgtatggcagtgggcattaggtggcttgtgaatttgagaactgctctatggggttagtgtctgagattcatcaactgagcatggaataagaagagaatagcactttaaagaacattaactgaggactttgctaagcatttatttaattagggaaagcttcaaaagttgaagttcaatcatgggactttcaaaataatccaagtgagacatgaagagactaagctgagggggagatccatggaaatgatgtattagaatcataagcatgaactgtttcaacagacaatacacagaatttggaaaaacgagggagtgatatctctaagatttttttccacaaatcaacattcatacatattattttgtattcatatactgtgatcttcatggagtaaggtgctaatgtaaaaaaattgattattggagtttataaaagcaacttttgaccattttctgtgtgtgtgtgtctacatagcaaacttacttcctcagagaagcagaaactctttgtcttactgacactggaatgtatcctctgtagttttattccatgaaaaagataactaggctgggcgtggtggctcacgcctgtaatcccagcactctgggaggccgagaaaggtggatcactaggtcaggagattgagaccatcctggctaacatggtgaaaccccgtctctactaaaaatacaaaaaaaaaaaaaaaaaaaaaattagccgggcgtggtggtgggtgcctgtagtcccagctacttgggaggctgaggcaggagaatggcgtgaacctgggaggtggagcttgcagtgagcagagatcgtgccactgcactccagcctgggtgacagagcgagactctgtctcaaaaaaaaaaaaaaaaccaacagcaaaaaaaaaacagataactaagactttggccctacaatatttacactctgcatggaaaacaacccaccaaatatgttttctgtacttactgaaaaaccaccaactatggtttcatattcactgaatacaagtaaattaatgaaacattttcaggacaatcaggcacagattgctattttttctattgagttgagataattatttgtgctaataatagaaagaaagtgtgtatccactcctggaaggctgtgtgctgtgctataagagaagctgatgcctctgcttccccatctttgttctgtggagccacacaggcagcctgatacctgggcaaatgcttacctgcccagatccgaagggctggtgcacccagagtcgtggctaggttgtgtgcagcacaaattcccacctctagtttccctgctttactcttttcctaagaaatcagaatctgagctttttcaaaataactggagaagaaatgaggcagaaagtatctttttaaacacaatcctcattcactcagaaaattgagaaaaaagttctaagtgataattgatgtcaacctgtaaaatttttcaacagcttgagtgtctattttctctacaatattgtcatcaactcataaccaaatatcacaaataggcagcataatggcctcattagggcagtttccacagtgacccacatcatcaacaatggcatgcatctgtcatgcatcttcccagaaagtcctaaaattctacaggaaaaacctcttggaaagaaagtttcgaatgttgatgaggtccacccatatagttaatctcttcaggtgagaagctagaaacataagacacttcttcggtttcatccattttgtaaactcatttgctgaaatgttcttcacagtaatatctgtgttcactgcattgtttccaagtatttaaaatccctgaagaagtaagtaatccatgtgttttacgccatttcaacagaaatgtcttaggcaatgtttatctttgctgcttacagatccccaaataagacagcttgcttcattagtgaaggccccttgaaaaaattctcaaactctccttcggtctaatgcatggttagttattgtacattcattttgcaactttaaaaaggagcaattgcagaggtctcaagccacaaataacaatgctgtctaacttcgttagaccatgaaaacacatgggttatccttgcaaaaaagcatatatattttttaatttattgcagtagcatcttgaattacatctatcatgagagaatataaaatctttttcatgtttttcacacactgtcataacttattattgttttccattatcttaatattctgctgtctaagagatgtagcccctgggtgacctgaaagtctggtgaagctagtatgatcagggatataataagacagtgaccatctatggaccttggacacaatactagagagcatgatagatgtgtgtgggccataatgatgttgatattaatatgctattaattcctctctgactccagtacatcatctccaccttgtctaggttttgcatttccaaatacttgccctttctctcttaataattctccttaatatcccacattcctttaacctgaggtggaaaactcataagtggggagggaaatcctaaaactcactaggtgacacaatacactaaaacattccagcttgggtcagcagacatgttacagctacagactcttatgttttctctctttagaccaaagagtttatcttacactcatcatgtgttggtctgtgagcggccaagacaacattcaatgagcaaccagcaaaccctcccttatgctagaatgcttacttatggggatactaaaaacactaggtctgttatagttctacttggaaacttcagatgccttttcttctaactctgaaattttaataagatggaagaagcactttctgcataattgtttatttaaaactaaatgcaattccaacccagaagaggcctcttttggacaagactagtcaagttacagatgaagacaacagtgtcttagctgtcagtgagatagccctctttgatcttggggaattctgaaggaatttctcatttcaaaataagaataaatacttttgggtaaagggaggagagaaaattcttcaggtcaccttccattttttccttataaacaaattacaatcagttgacctcagcctagcattttgattaaaaataactcaagacaggactgaaagaaaacaccaagaagagtgttttatcctaatcttagaaaggcatattcatatgacaaccagcataagaagcaaggaatctgaattacagaaaaataaactttaaactgaaactgctaatataataaatgcagaggagacacagggcagcaaatgcacaaataaatgtatgtctttagccagtatgtgaatgatacccaaaacggctggttttccatctcaaacagtcatggaataacaacttcacagtgtttattaattgttgaaattgtctaaaacaagagaatatattttcacaaattcatctgacacagacacagctataagcacatgagaagacaggcctaaggaaaaaggtaaaattaattcacctatgtctgtatttgtcaactaaacaaagcatcaatccatttattataaagtataataaaactaaggacaaccattgcataattaaattgcctctgaaagccaattattgattatggagaaaaccaagttttacaactgtatgtgtgtatcatataaagatttcatttcctaatatagatcattcattatttattttgaaatgttaagaatttactatgtgccagtgtatcatttgaattctcatattttaaacattttaaactataggttaattttctgaaattttcaattagtgtcagaagaagttacagaaaaaggaataacaaacatgtttaaataattaaatggtttcaatggcatctctgaatttctttgatattattatcaaaatgttttcttcaattctactcaaaaccttatttttttgccctaagtctttgtcagcttatttcagtcttatttttacatgtaatataccacagagttcttcttagcttcaagtgatgcaatgtgaaaggtgtagaaatgcacactgacccttagcctcttaaatttacaacaggtcggccaggtgcggtggctcacacctttgggaggccgaggtgggcataccacgaggtcaggacattgagaccatccgggccagcatggtgaaaccccttctctactaaaaatacaaaaattagcctggtgtggtggtgggcacctgcagttccagctactcgggaggctgaggcaggtgaatcacttgagcccaggaggcggagcttgcagtgagccgagattgcaccactgcactccagcctggcaacacagcaagactccatctcgataaataaataaataaataaataaataaataaataaataaatttacaacaagtcactttatcctcaaattagccaataccatgttagaggttatactgaaattctaactatgaagatgtagaaagcaaaaacatatttaattagttataatccaatctgtgcaatattcatgataatacatttttacaagttgaaagtaattctggattatgcttcataacttatgaaacctttggtggaaaaattgagtcttccccattaaagggaattaaataagttgcttataaaagtgcattaacttgtttggcccatgggttcatcatttagtggcatggaagaactagtttacttgtggtatccaagaggcatgaagaaagacacctccaaaaagtccattttgactctttacactgggacagacgggatgcatagctaccttgttcccctctcacccctcaggctaaggcttgagtaactatcgcagctgtttccatggcgtcttcccatcacatgggaagaaggcactgggctgcacaacagggaaactacttgttttctgcctgttaatttttagctctgagatctttacactccactggagaaaggctttaatgtctgagacagggggtcattatttgttagtttaattatttatgatcagaacatttgttcagtcactcttccatagaccattctgaatctaataaaggatatgaaaacactagagataatctatagccttcaataaatcactcccaatttggaactcctttgatgaatactccaggctaccacgagggagaagaaaaaagtcaaaaccaatttaaaaaagcaacaacaatgaatttgtaataaacttagttgatagctaactaaagtaagcctgtttttctaacttcattaacatgaaaataaattttattaagattgatatcatgcttttttgcacgatgagttacaggaacatgaactaagaataaaaatgatccctaagataaagaatcctcataatcatgtactttagtacaaaatatgatttgacatcaagaagagctatggcttgagattgctcttgttttcctttaccccctgtgcccaggcttagtcactgtttcagtgataatgaccatccactgaggctctgcagcaatagaatctaaagtaacgaaacagagcccatatctctgcaacaaatgaaatcacagacttaagaaaaataaacagaaaaacgaaaagttaaattgtttatgtttcatagccatactgcctataacaaatgccagaacatatttatttggtccaatgtgcaatgcattaaatgtgctcaaatacagaaaacaccaagaaatgcaacagggagttaaaaaaaaaaaaaaaaaaaggctgggcgcggttacaggctcacgcctataatcctatcacttcaggaggctgaggtgggtggatcaggaggtgaggagatccagaccaccttggctaacatggtgaaaccccgtccctgctaaaaaaaaaaaaaaaaaaaaacaaaaaattagtcaggcctggtggcgggtgcctgtagtcctagccacttgggaggctgaggcaggagaatggtgtgaacccaggaggcagagcttgcagtgagctgagattgcaccaccgcactccagcctgggtgacagagcgagactccgtctcaaaaaaaaaaaaaagaacaagggcaataagaaaataggaaagcacaattatataaaatacagtagacacttttgaatctttttaatatatgcctacaaatacattttattaatagtgtaaatttaatttcctctgagaatttattcaaagaagttctatctgagtttgtgctcagaaaatgccaggatgattccttgtcacaatgtatttggtgtttaaagttccctctaatttacacagcaagacaacattcaattttctacacttctgcttaagcatatgtaaaagaaacacactcctcatgagatatgtttacaaatataaatggaatagtcacagtggagcatgaataaaccattacatggttatttctctacagtggatgctaaagagagaatcaagtccaccataataagaaataaactaagagttgtagttaaaacataataaaaatcttcttaaacgcttctttactttgccaattttctcatccaaatagggataattaaataatctgggacaacaaaatgtatactgtggcagaacaaaagaatccaaggtaaaaaaaaaaggacatggcagaatctaaggtctttgataaataatactcagatattgcaaggggtatacaaagagttcaaacactgtcaaagtcaggtgtgacttgttcaaggcacacaaagatcataccaagggaaacccagcaggacaagaaagccgaagtgatcaacttattcctgtcaaatacattcttggagtttcaaatgtgaacaaatatgcttattctgaattttacttccttctgcaaagtattaatcaattataattattttgttaaatgaaaatccaatgagagtcaccaaggagcaatacaaggaaaaaggcagactcaccatctcttcgattaagccttgaaaaccccgggccgtggctgctggacagctctgaggagctgctgaaggatgacctaggcaaggcagaggccagtggggcatcacagtcagctgccaggaaaaataccgtgatatggttaacactcagattgcagcttgggagaaataatagtccaaaaatatatatgaatatattctaggatgtatggcaatcatcactccttttttaattctttacaatttttaaaatttacattgcagcataatttacagagagtaaaattccagagaatttatttgatgtttttaaagtgtacagctctattcattttgacaaatgcattcagccttgtaacctccaccataatgaagacataaaacaggtccattagccctcaaagttccctaatgtcccacattttctcaattctgcaagatgtctgggtacatcacccatccaacactactttaaactcaatttgatgcttaggttctttaggtacacacatacagaggtagtgtgaattctgtgcccaaacctcaatagcggctagaaattctcacagtgccccagcacagaacctgtgggggatgggaaaagtgaaatgcaccaggtgttcaggtcagagttacctgcgtgaagccaggacccatgagaggcaacacctgtagtgatgaactggaaaaagcccactctgtagacccctccagagggaattactgcgggctacttgcctacaggagatggaggctcctcctttttgcctgataacttgagcattgcaggaatttgctctgcctttccaacccaaggacccctgcatgtcaccatgtcaccctcacctcagggtgactctctattgcttcagctctggtctaaaagaattgctgggggttaagtagtgtttgacccagatcatcttatttgtcctaagaccataaggaccctcagagccttcttgcccctggtgttccccaccgtcaaacttgaggagcccctgggaccattcccaccttgggtagctcttttcctatgcgtagccatgggtaacagaagcaacccagaggttacctctgagtcccgcagtccaatcctgtaatcactgtactttcaggcatgtcatattattttctcataaaaagggtacctcttccagcatggttattgatctaataatgttacacataagttttctgtcacacattaagatatgtctgtgaaagaggaatgttataccttgaatatatcattagatgattctgaactgcatattttggatacactttttttctttgtgagcaacttgttaagtcacagaaagaaggcaaccagaattaattagattgctacgacttagcaaaatgtcaactatgttcagtgagatagataagaggtaattcagggtctctcctgatttgtttggttgagtacatgatactgcaacaacagaaagaaaattcagtgcacataatttgcctgagtgaatatcatttcataaagaaatactggaattatatctgcttttctaaaagcatgcattgccattaagacagtgacatgtctttaagacatgacaaaagaaaaactcagtaactcattgtgaagcatctattctacaatagggagaacagtatctcattgcttggtaaaacattcagagtatttgatataggaacatttttctatatattccccataagtgacaatgtcacatttatacaggtgagtcagacactggaatttgtgattttttacatacaaagagcagcataatctagctaagaaattgcatttaacatctttagcatgaagagcacccaatatttttacacagcaagaagccattgaaatgtgcagagctgttaagaaaggtttgctttctctacgctttccttaaatgtccccctcaatgtttatgccacaagagaggctttcttgatttccccagcacacatgctctctggataacactgtgcagtcgggattcccagatgtcagcaaatatgctacagagtgggctaagaaaaatagataaatacgaatccaactggctacgaactttacttacattttctaaaaaggcattttaaaactgtgaagaagctaaagtacaagaaggcaactaaggctctgctccatctatagacaagtcccacatggcccacgagtggtcacagcaggatccaagaaggaaggacatcatccagggaatagtgcctcctaagcctgtctgcctgatgttattttctctctattttctgggaaagaataaaacaaatccaagaacatctaaagtagcattgacattttttggataaaatctcttcctacattagaaaagcatgatagctgttctcatgatgcctctgtcctgcagtatcatgcaatacataaaacagcactgggcgtttcacgtgtccctggattcctgcagtatcatgcgatacatgaaacagcactgggcatttcacatgtccctgggattcctggctgacatgtctaactctctctgtggaatcatgagctcttgaaggcacaataaaagtctttcccaacttcatgtgctctatacctagcgcagaatctgaaagatagcacatgctcaataaacttcaactgaatatttactaaatacgtaaaagagaattatcattaaccaatacacttaattaaacttagtcttcctaagttagcagagtacaatttattaaagttcaaacacaagaggcctagaggtatcagattcacatctctaataaaaataataaccagatctcaagagaaggttctaaataggtgtaatagataatagttattctttcccttggtttctccctaattaactttccaattgtgtgtttcatgagtttcagatgatttccaataggattaaggtccaaatataaatctgtaaagacagctggaaacaaaattgctgaaattttccatttcgcctttggaaaattcaagagtcaatagcatctgtctgccaaagagtcaccttgtaatgaagaaaatttctggcacaggcttgaataaatcttgcccttcagaaaggcaataaattcgggcgtggtggctcacacctgtaatcccaacactttgggagaccaaggtgggtggatcacaaggtcaggagatcgagaccatcctggctaatacggtgaaaccccgtctctactaaaaatacaaaaaattagctgggcatggtggcacgtgcccatagtcccagcttcccaggaggctgaagcaggagaatcgcttgaacctgggaggaggaggttgcagtgagcccagatggtgccagtacactccaggctgggtgacagagaaagactccgtcttaaaaaaaaaaaagaaagaaagaaaggcactaaattttataaaataaaagaacataagaacatatctggtacctaagtttattgttttttccctatcattttgaattctgtaaacactttctttctagaaagaattgtacactactgagtcagaggggaaaatacagtgggcaccccacaagtgttacaggggctggatctccctcttcctcagcttatttggaaatctggttaagattcactatatttccatgtgcttggctcaatatagagggttctagggtcttaatgttacaagtattgattatttcacatttattctcaccatctaaaggcagagattcattgctacataggtatattttatattattgttctcctagaagatcatggttgaaaatgatataaaatgttttattcagggttattttatatctgttcaaaaatggtggacttccttaaaaatcacctgtgctgaactgggtaacagctggattcatattaaaacttgcaggtttgaagaagagaagcatttggaaaatgcagagaataaacacagtatgggttggtgacttagctgaaggctcaacaacggttgagagagaagtagagataaacccatagaggatcccacctgccaccttccatgcagccacctcaagtgacaactttgaagatgcacgctagaccagagggtttttggcttgctgcacttccctaggcttgttgatttagtctcggcgattagctctgcctaggttcctctctccccactctatggtcttggtttgtcccctgacccctgcctggcatcactcttagctttccacttctccttgacaagtattcccagcatgctttgtgattcccagcatggtgcctatgaacggtttgggacagaaaccatttcttagtattatgttcatgaaagacagcagaagattaaaattagcctaagggcttcctgtatacaaatcaacattgcattcacagatgtgctagtttatgacaatttttaccacatgaatatgaaatgattaaaaaatcaatttgaggaattgcccttacctaagacagagatgatatacttttcaaaacagcgtttcatttatgttaattcttgcacttatttaataaaagtgtattgagcacctaccatgtgcaaagcattatggggcataaagagagacatagttctaggttcaagaagtccagaatctaacatgggagggagatgtgtaaatatctgttataggaaataaacagaagagcaaaatatttagatactactatttattccaaaacacagggaagcatcttaattgcttaggaacaaaaccagcctctgaaagagcaaacagtactagggagagatgcgtataaaagtgcttctggaaaagataaacataaaccatgcattttcaaacagcaattcattattctgggatctgataataagaatgaaaaaaaaaaaagaatgcatggataatacatggacagattttgtccgtatctgcagaggagatgggaaaagccaaaaggaggggcgacaactgatcctatggggaggagctttacattcaaatgaggacacctcctggcatctccagatggagctccgaattcattacagtattacttaaaggattttattaaaagaccaaaccacactgcacttgtggctgaatgcctttatcagagatgaatcttacatgtgttaggacaggctgacagtggctcccaaagatatgtctatgccccaatcccgggaccctgtgaaggttacttcagaaggtaaggttctccagatgtgatcaaagaccctgagacgaggaaattatcttgaattatctggctgggtcttaaataccatcagaactgcccttgtaagagagataaaggtgatgatgaacagagccccacacaaaagagaagagggtgtgaaaatggagtgaggcacccacaaggtgaggcacacgggcaaccacaggaagccggaagaaacgaagaatggatgtccccctagagccttcatagggagtgtggcccatcttgattttggactagggatactgatgcggaacttctggtctccagactatgacagaataaattcttttgctttaagtcagccagtttatggtcatttctcacaagggccataggaaatgaacacactgtttatatggaattacatattggatattttagggcaaatgcaggagagttccactgaaaatacgattaacatccttttgaatcgcacagatactcaattccttctgagaagggcttcatgatgctaagccactctgccaggctgtggctctccccatgcttgcggctgcacttgctcctcactgtgaaaggagctaagcactgtgtcggcggaacctaacgatggaaggagaggggaaggggccaccgaattgctaatatgaggggacggcaccttaacaagcttcgaattatcagaaaaacacaaagcctattattaaagagttcaacagatggttactgtgttatcacagatgtacagaaaacctctttgttctaaaaaaagaaaaaagaaaaaaaaaaagattcctgtcctttctcagactgtctcgattaggtcaaattcactaactccacagcaggcttctctctggttccacatattgagtcagcagggagcacagcctcgggaatcgaatcacaaacagggaagggggtgcccataccttcttcaggccacgtctggatgttcatctggatacggcgctattccattcttcccatttcatcacctgtcttttcagttcttaatgtaccttaacattatcttaatgagaggttaaataatgcttttatttagaaggtaccaaaagttcatcttgttatgaatctgaattgatctgtgcattgctatctagagggaatgctttggaaaaagtacattttactcacagtgaacataagcagtgatggtcaatgtaaaaatctacttttttccatataaaaacttctgttttacatggtcttgatctccattcgattatcttcagtcactgtcttccctacatctcactccatggggtctgaagggggctcaccctaccacctggggccagcacagggacacgcctcaggcctggcaactgaatgccatgcctgtcctactggaaaggactggttccaggatggtcaggaagcccacgctgaatgaatgggaacagaacctgggactttcgaatgaataacagcagaacctgggactttcggcttgaactcttggaagaaatacccattcattcattcaacaaatatttgttgaaaatctatactgtgccaggtgtgcccctatgttctggggatataaccataaacaacagaaaaagtctctgctcctgtgaagcttatcctactgagtagaataaacaaataaaggcataatatctgtagaactcaacattgctaagaacagaaataaaggaaaatagtcacgctcctaagctggtaaacggtatgcctgaagctaaggcatagacagagctgcccaagaatgaggccagttgtagatgaaaataaaactgcaagaaggaaagaggcagactgctgatgaaagaatctgattgcctaaattcagcctggcttcaatcaagacactttggttccctttattattcaagcctatttgatcttagattttggtcacctgaaactgaaaaatgctcaataagtacactgtcctgagcccccacccttatcttccctttacagccaataaattgacaaggattatgtactttttgtgtgtatatggcagcttttccattatcatgatcatcatctcactgtaggtcctcatgttaatgacctaactaatccttacagccaatgtttccttattgactgtccccagccacacacacaccttacatatcaccagagcagaaacagttttaaactattgctgagtgcaagtcacacaaacagccatatcaaccagctccaatggatccccactgcacctgtcctgaaattcaaatttcaggtcctggcattcaattccttccatcacctgttccctgtcactctctgcactacagccgaatcccctacacatttctcagatgcgcttcctcctttaattggagtggtcttctcactgtttcctgaatgtgggatgcatgcaccaacgctccttgaccgctcacccgatgacattgcagcccctcctgtctgcgagttcccatcacttattatcttcagggctcaactcaagttttgtctctgctctgaagtcttctcacatgtgtgaaggccccagtaaggcttactcttctgaaatactgaggtctgtctcatggaaaatgaattacacctctggagaaggagcagcacctcactcacagggagccacacagcagccacgtgcggcggcagatggggatgagagggaacaggagaacctcactcccaagaaaggagccttgcctgctgactgatgattctggggtgaggaagagagactggcatgaccagctgatgagtgtctggttcccgggacatgacagacaattcctacagtctacctgtgggaacagatgaggcttggaagaagacacatagaaacaggtttaaattctataaattagaatttacagggggtaggagataggggttacacgttgtctctccttccagatgacattttgacttgttaaagaaaacctagcataggaacattgaatacctcctgacattggtgttttcaaatgacttacagcactacaaatataaagttataacaacagcataccaattttaacataccaggaccaaggactttattctatgagaactacaaaagacacaacacaaatgaagacctagaggaaagtttacagagtttttttttttttttttttgagacggagcctcgccctgtcgcccaggctaattttttttttgtatttttagtagacacggggtttcaccatgttagccaggatggtatcgatctcctgatctcatgatccacctgcctcaacctcccaaagtgctgggattacaggcgtgagccaccatgcccggtcaagtttacataaatttaagcatcttaatttgacgatctactctacagtcattacaacaataaatataagaactatttaaacatgtggagagatgaaggagatgggatgggaaaatctgcatatgagaagataatggacaaagagatctgctggattgagatgagataatgggtgttaaatccaacaaacacagctctagaaacacagaagggattcaacatagatcagctccttttccctgaggaagctggatagatgatcttgttctctttccttttatttctaaatttcttgctatgtagttaaattatacttctgtgataaattcaataccaatttttaaactatagatttttggctaaagtatataatacgagaataagacgaacctatttttttgagacttactgctaagtagaaagagaggaaaccaaataacaaaattaagtcctgcagaaagacatcagacacgacacagaaaaaaatacaacaacacaggtgcatataatttaaaaagaaaatcatgtggcgatgtcatcactaataattgttcttacgaatgtatccacagctgtgggaatataagtgataaagatgaactgttaataaagggcaataaatgatctttccacgggtacaaaaaaatagaaaaaatgaataacacctagtatttgataacacaagagatgactatagtcaataattacttaattgtacatttttaaataacttaaagagtgtaattggattgtttgcaacgcgaaggataattgcttgaggggatggatactccatttttcttgatgcacttatttcacattgcatgcctgtatcaaaacatctcatgtagcccatcaatatatacacctactatgcaaccacaaaattaaaaactaaaaaaattaaaaataataataattctttctatgcacctctgagagttgacagaattagggtctgaatgagaatataaggtatgagaaggatatggcttcttcccaagacatgttacagagggatggaaagaagactgtgttcaacttataacatcttaaagggacctcatgacctcacaggccagagcaggctatggagcatctgggagctgaagaaagagaacttcagtgatacttaagtaagggttaagagatgcactccaattgcattctgaagacagatcccaacaagaccaatgacatcagctagatttttttcagcccaaagtaataaacctgcaaattatcagaacttgttcactactccgtacttggctctaatatgattagtaaggtggcagtgtcagaatccttgagaaaataataaccagaacatcttagaatttattgtgcccaaggaaggagccctgtcaatagacaaatgtttatttgagatgtcaaaaagataattttaaaactttaggaaaacaacaggcattatcccatggcaatatgttttatgtccaaatttcaactctattatttcaagctatgtgtgtgactttagaggcagctttgacttcaattttttaacttaaaaagataagagtatttagaacacaatgggaaatgttacataatactaccttgtagacctccgagcaaccactatacaaagagacactgttgttatgattgaggacaacatcgttcatcaaatgtgaaaagctacccaaatgaaacccagaaaaaacatgttccactgaagaagagagaaatgggcaaagtaaccaaggaaagaatatttacagtgaggctgggtgcagtggtcaagatgggtggatcacaaggtcaggagtttgagacgagcctggccaacatggtgaaactccatctctagtaaaaatacaaaaattagctgggcatggtagcgggaacttgcaatcccagctactcgggaggctgaggcaggagaattactggaacccgggaggcagaggttgcagtgagccaagattgtgccactgctctccagcctaggtgacagagcaagactccatatcggaaaaaaaaaagaaatacttacaatgaaaaggaacattaaaaggaggcaatataaagcaaagtgagttaaagcccagaacaaattaagactttcaaacattgctaaacgcaatcaaagagattttttgtatactcataagaaaaaccagaagaagctgcactcttttgacaaagctcataaggctaagaaaatagacaggtccggatccaagatggtcgaataggaacagctccagtctacagctcccagcatgaacgacgcagaagacaggtgatttctgaatttccgactgagctttggtgacagtagtggttctcccagcatggagtttgagatctgagaatggaaagactgcctccttaagtgggtccctgacccctgcgtagcctaactgggagacacctcccagtaggggctgactgacaccgcgtacagccaggtgcccctctgagacgaagcttccagagaaaggatcagacagcaacatttgccattctgcaatatttgctgttctgcagcctctgctggtgatacccaggcaaacagggtctggactggacctccagcaaactccaacagacctgcagctgagggtcctgactcttagaaggaaaactaacaaacagaaaggacaaccacacaaaaccccatctgtacgtcaccaccatcaaagaccaaaggtacataaaaccacaaagatggggagaaaccagagcagaaaagctgaaaattctaaaactcagagcgcctcttctcctccaaaggaacacaacgcctcgccagcaacggaacaaagctggatggagaatgactttgacgagttgagagaagaaggtttcagatgatcggtaataacaaacttctccgagctaaaggaggatgttcgaacccgtcgcaaagaagctaaaaaccttgaaaaaggattagacgaatagctaactagaataaacagcgtagagaagaccttaaatgaccagatggagctgaaaaccatggcacgagaactacatgacgcatgcacaagcttcagtagccaatccgatcaactggaagaaagggtatcagtgattgaagatcaaatgaatgaaatgaagcgagaaaagaagtttagagaaaaaagagtaaaaagaaacgaacaaagcctccaagaaatatgtgactgtgaaaagattcaccaaacttgaaatgaaggaaaaaatattaagggcagccagagagaaaggtcgggttactcacaaagggaagcccatcagactaacagcggatctctcggcagaaactctacaagccagaagagagtgggggccaatattcaacattcttaaagaaaagaattttcaacccagaatttcatatccagccaaactaagcttcataactgaaggagaaataaaatcctttacagacaagcaaatgctgagagattctgtcaccaccaggcctgccttacaagagctcctgaaggaagcactaaacatggaaaggaacaaccagtaccagccactgcaaaaacatgccaaattgtaaagaccatcaaggccaggaagaaactgcatcaactaatgagcaaaataaccagttaacatcataatgacaggatcaaattcacacatagcaatattaaccttaaatgtaaataggctaaatcctccaattaaaagacacagagtggcaaattggataaagagtcaagaccaatcagtgtgctgtattcagcagaccctgctcacgtgcagagacacacataggctcaaaataaaggtatggaggaaggtctgccaagcaaagggaaaacaaaaaaaaagcaggggttggaatcctagtctctgataaaacagactttaaaccaacaaagatcaaaagagacaaagaaggccattacataatggtaaagggatcaattcaacaagaagggttaaatatcctaaatatatatgcacccagtacaggagcacccagattcataaagcaagtccttagaggcgtacaaacagacttagacttccacacaataacaatgggagactttaacacaccactgtcaacattagacagatcaacgagacagaaagttaaaaaggatatccaggaattgaactcagctctgcaccaagcagacctaatagacatctacagaactctccaccccaaatcaatagaatatatattcttctcagcaccacatcacacttactccaaaattgaccacatagttggaagtaaagcactcctcggcaaacgtaaaagaacagaaattataacaaactgtctctcagaccacagtgcaatcaaactagaactcaggattaagaaactcactcaaaactgctcgactacatggaaactgaacaacctgctcctgaatgactactgggtacataacaaaatgaaggcagaaataaagatgttctttgaaaccaatgagaacaaacacacaacataccagaatctctgggacacatttaaagcagcgtggagagggaaatttatagcactaaatgcccgaaaaagaaagcaggaaagatctaaaattgacaccctaacatcacaattaaaagaaccagagaagcaagagcaaacacattcaaaagctagcagaaggcaagaaataactaagatcagagcagaactgaaggaaatagagacacaaaaaaacccttcaaaaaatcaatgaatccaagagctggttttttggaaagatcaacaaaattgatagaccactaggaagactaataaagaagaaaagagagaagaatcaaatagaaacaataaaaaatgacaaaggggatatcaccaccgatcccacagaaatacaaactaccatcagagaatactataaacacctctacgcaaagaaactagaaaatctagaagaaatggataaattcctcaacacatacatcctcccaagactaaaccaggaagaagttgaatctctgaatagaccaataacaggctctgaaattgaggcaataagtaatagcttaccaaccaaaaaaagtccaggaccagatggattcacagcccaattctaccagaggtacaaggaggaactggtaccattccttctgaaactattccaatcaacagaaaaagagggaatcctccctaactcattttatgaggccagcatcatcctgataccaaagccgggcagagacacaaccaaaaaagagaattttagaccaatatccttgatgaacattgatgcaaaaatcctcaataaaatactggcaaactgaatacagcaacacatcaaaaagcttatccaccatgatcaagtgggcttcagccctgggacgcaaggctggttcaacatacgaaaatcaataaacgtaatccagcatataaacagaaccaatgacaaaaacctcatgattatctcaatagatgcagaaaaggcctttgacaaaattcaaagacacttcatgctaaaaactctcaacaaattaggtattgatggcacctatctcaaaataataagagctatctatgacaaacccacagccaatatcatactgaatggacaaaaactggaagcattccctttgaaaactggcacaagacaggatgccctctctcaccactcctattcaacatagtgttggaagttctggccagggcaatcaggcaggagaaggaaataaagggcattcaattaggaaaagaggaagtcaaattgtccctgtttgcagatgacatgattgtgtatctagaaaaccccatcgtctcagcccaaaatctccttaagctgataagcaacttcagcaaagtctcaaaatcaagattttgtatcttgatttgatacaaaatcaagattttgtatcttgatttgatacaaaatcaagattttgtatcttgatttgatacaaaatcaagattttgtatcttgatttgatacaaaatcaagattttgtatcttgatttgatacaaaatcaagattttgtatcttgatttgatacaaaatcaatgtgcaaaaatcacaagcattcttatacaccaataacagacaaacagagctccaaatcatgagtgaactcccattcacaattgcttcaaagaggataaaatacctaggaatccaacttacaagggatgtgaaggacctcttcaaggagaactacaaaccactgctcaaggaaataaaagaggatacaaacaaacgaaagaacattccatgctcatgggtaggaagaatcagtatcatgaaaatggccatacttcccaaggtaatttatagattcaatgccatccccatcaagctaccaatgactttcttcacagaattggaaaaaactactttaaagttcatatggaaccaaaaaagagcccgcattgccaagtcaatcctaagccaaaagaacaaagctggaggcatcacactacctgacttcaaactatactacaaggctacagtaaccaaaacagcatggtactggtaccaaaacagagatatagaacaacagaacggagccctcagaaataatgccacatatctacaactatctgatctttgagaaacctgacaaaaataagcaatggggaaaggattccctatttaataaatggtgctgggaaaactggctagccataagtagaaagctgaaactggatcccttccttacaccttatacaaaaattaattcaagatggattaaagacttaaatgttagacctaaaaccataaaaaccctagaagaaaacctaggcaataccattcaggacacagtcatgggcaaggacttcatgtctaaaacaccaaaaacaatgacaacaaaagccaaaattgacaaatgggatctaattaaactaaagagcttctacagagcaaaagaaactaccatcagagtgaacaggcaacctacagaatggaaggaaatttttgcaacctactcatctgacaaagggctaacatccagaatctacaatgaactcaaacaaatttacaagagaaaaaacaacaatcccatcaaaaagtgagcaaaggatatgaacagacacttctctaaagaagacatttatgcagccaaaaaacacacgaaaaaatgctcatcaccactggcaatcaaatgcaaatcaaaaaccacaatgagataccatctcaccccagttagaatgacgatcattaaaaagtcaggaaacaacaggtgctggagaggatgtggagaaataggaacacttttacactgttggtgggactgtaaactagttcaaccattgtggaagtcagtgtggccattcctcagggatctagaactagaaataccatttgacccagccatcccattactgggtatatacccaaaggattataaatcatgctgctataaagacacatgcacacgtatgtttattgcagcactattcacaatagcaagacttggaaccaacccaaatgtcaatcaatgatagactggattaagaaaatgtggcacatatacaccatggaatacaatgcagccataaaaaatgatgagttcatgtcctttgtagggacatggatgaagctggaaaccatcattctcagcaaactatcgcaaggacaaaaaaccaaacaccgcatgttctcactcataggtgggaactgaacaatgagaacacatggacacaggaaggggaacactacacaacggggactgtcacggggtggggggaggggggagggatagcattaggagatatacctaatgctaaatgatgagttaatgggtgcagcacaccaacatggcacatgtatacatatgcaacaaacctgcacgttgtgcacatgtaccctgtaacttaaagtataataataataaaataataaaaaattgaaaagttcagtgttcgagttctctctttgtctcttggcctctgcgatgcctgcagaaacccagtcacaacccattcattcatattcctctccttagagccaggagttagcaccccaagggcagtgctgaatccctggacaggactcgggataaatgcattccccctgctgtctctcagaggcacagctgtgaaacacattctaccggcttcctgagagcttcccagggagttcgtgccccagttgctcacagaagtgaccagctcaatgacacccccttttggtggatttttcttctctattccattcttccctcttttatgtgctcactttctaaaagaggctacctgcacaaacgcccatcacaggctcagctttctaagaaaactctggctgggacagtggactttccagaatggaatgtgggcagtattctaaaatactaaataaaatgcaataggaaaatcaaagggatgaatgtcacatggcataaagaaggaggtagaggacatctgcctagcctgccaaaacaaaacaaattgacaatcaaccccggccacccaggagatgagctttgtcacagcaattcttcctcatatcccagaaaagagaagaagaaatgaggacagtagaatcaactgtgacatccaaaaaaggaaggctgcccaatctcttctctagaatgtgtcaactgtgatttatgaaatgacatatgctatttttatattgcaatgtttgcttatctataggtaagagctcactatttcttatatcatgttataattatattcatgaagaagatgaccactgcacagacaagtacactgtgaagaaccgtgaggagagattttaccctacttgcaagctaacaaatgagtctgccagtttgtttcatggttgcggcagaagacttctgggtcaaagcaaaggactgtattacttacagcatagcaaacaatatgagcatcagcatatttgcatcaatttccttgcctccaagtcctctgggggaatatggatgggcacagatggatgtgtgcacacgcagtgggttacatgacaagtgaggagccccgagcttagggaattcaaagttttctatgggcagcaggcattgcttgccctttggcaacactgctgaaataaatctcttatagttcaagatgtattgataagcgtgttaagcttatttttatacatgaagaataacaaattgttattttctatggttattcacagtatctcaaaatctatgtgatattttactagcttagttttattataattttaaaagaccatttgggttcctttgttagtggacaagaataaaaagagataaattagttactttcttaaagctaagcaacatcattttctattgaggaacccaaaactttcctaacttttacaaatgtttgtaaattgtaggttctgtgacagcctgtgctataaaatttcataagcttataagagctttcttaacacagctgtggacttttctcctggtgttgtacagcagttcaaattagcacaagaatcataaaccctatatttgaacagctatataatattatatatttattttcccatttgatgttgcattactttttctaccaatcttcttacaataaattcataaatatcttaattatagcaaatgtgcagttcttaaagatgagaatcatcaaacatgtttctattacagagatatattcttcaaaaagtcatctaaaatagaaacccaactgggagacaccttaaaaggttatctgccacaacagaagctttgcttaaaatactgttctctttgtatttgtgttaataattgatttgtctttgaaattaaattaggaatctactatatctagtggtcttgaaatcaaagccccctccccattccttatcttcactgctgtgttcaaaaagactagactccagggacctgtccaaagctgggttaaatataggatgtctgagagacacccttctttcatagttcgagggtaagcatgtagctgtatgtgtgtggaggggcgggtggaggaggttagctgtatcagggtaggcataatactatattttaaatccctccttctgttataaatgtaagctgaaaatagtctctgctcccagcggcagcaatcgtaaactcgcttagttctgcctgtaatttaatttaatttaacatgtgacattgagacaatgtttcttttaattcacatataacttcttcctcacccacattccagccaaataaacacatacttatagaaaaatgtgactgttttcctgggcaccccaacaattcaactgtccctaaaacaccaggttcaatttaaactctattagcttgtctgagggctaagatatctaaaaatccaagacaaattatcatttgcatatatggaggcagctctgattgaacagatatctaaaactgataggtaatattttagatcaaatcaccccatcaagtcaaagactaattcaactgtttgttcagtttccaaaggaatccttccattttggtctagtgttccataaacattgactttacatgaaaaggacagtgaagagatctcttgaaccggccagaaagttgaagctcaaggttgcagaagatttgagctaccaagtccaagccttctaaaagattcccaatatgtatatatatcattttcctaactccacatttgcctgagaaacaatgacattcaataaacttttttccacgggatttagttacaaaataagtcaaggaactacaagttatatatttcctggaaaaatatactattatacatatatattatatattcaaaactccgtaaagcatataaagtataagcatatactgagttataaggcataactcaacatgttattttaacctaaaattttcttagggcctcaattgcaaatgctttaattgccaatggttcataaacacatctgtgaattagaagcaagtaatatcctctgtttttatactctcaaaaaatgtgattatacttaatcaaaagtaattcaaaccacagcccaggcaatacatactagaccacgtcttcttggtaatttaattcttagcaataattttaattgctgccttattaagtaggtatgctacttaaattacaatcctgtagttataaggttaaaactattttaaaatctcgaatgtttttagatttcaatcactcttcgtattattacaacaaaaatgttcattaactggaacacatgcagtatcattttttagcccccactttatgatattttttaatttttattaccagagtagtcatttcattataaaattttaaccaagctaagcatatactccgttttttagaaaactagatttactgtagtcctgttaaggctatcatagtaagcaatgaatttcacacttgtcttttatacagtaccacaacacatcaagcagatatatgaattccttgacaaaatacatttaaaacaaacaattccatgctttatatgtcaagtggaaaaggaatattttttctacagtgacagagcagacttgacatgtgcacaatcatgtacaaccaagcgtttgcaaatgctcttacaacgtgcagcaaccgggcctagggacaagcaacctttcagctaagagtctcgtcaaaggtgcggaagcccattacagaagaccagataacagtcagtctgacgggttcattcagatattcaagctttaaaaagtacttcgaagactgatacagatgtcctaggcaataaacttcccaaaaagaatggagaacaatcccagtgccaattacatctttgtcattcagaaatccaggctaatttgatttagagacatatataaatgaactgttatttctcataattgttttttttcagcctctttatttttagtctacatctcttaggtaaaatacatcaatttaactacatttacttattctgagtttttctattggtccatgtttcctttaaacacaattttgaatggttttttaaagtaaccatttgattttgaaaccaatttacagaaaacatggaagaactatgctaatatgctgtatcacccctgaatacttcaatgtacatttcctacaacaaagatgttctcctatataaccataatatgatcatcacagtcatcatggataaagttccaatatttaatccccaatcttgttcaagtttcaccaattcccaatcatgtcctttataacataagcatttaatgcagaatagtatttagttgccttgttttcttagcctctgtcaatctggaatgcctccttcctcactccactcaacttctgacaacttgctataggtcaccaccagtgctgtctcctgtctctccaggtccccacccttgctatactgtggatgctttccttaccctgctggtttctgaatgctctgccatggtcctgggcctccccactacccagcatggatgcctaagccgaactgaatgaccttggactgaattgttcaaaaagagaaggggagaggaagaggaagaagaatgccaagtaatttgatttttcttttttcatgatcaaaccaatgtcttggaattaattatcatttccatgggctacttctgctccatactgtttgtatagagtttggtgaaaatgaataaaggcatgtgaactacattttttggggttttttttgtttttttttttgagacagagtctcactccgtcacccaggctggagtgcagtggcacgatctcagctcactgcctcctcacaggcacctgccaccatgccctgaaattttttcatatttttagtagaggcggggtttcaccgtgttgtccaggctggtttcgaactcccgacctcaagtgatccacccgcctcagcctcccaaagtgctgagattacaggtgtgagccaccgtgcccagcctgaactccattttttatagagtaccatttgacactaaaattaagagtctgttattcatctgcagaatctctcttaaaatggtattactaaaaggtccaaaatgaaacatctgtaaaaataattattcctacactctgtgagatctctttcctgacacatttcacatctaagtgagtttcctaactaacccacacacactctatagtaggcttacccttctttccccaggctggctagcgaacttgcaaaacataaccatttaggggaaaaaattgaggcaattaaaattaaaagtgttttaggctaagtaatgaataaattaacccactgaaaagttacatcaaaggctattactcagcattttaccaattacaggaatttctgcaaaatctgcccagccatttgtttgtgtatccctgggatcagtgcccagagttcaatctttctcttgatgcttcctgttgttttcagggactcaatgagagcagtaagtgacctttcactcagtgcaagtctatgggcactgaagttacgaaaatatttcccttcatgcagaatcttcctaacaaagctttcccatgtatttgtcgggtcaaataacattcagataaactgcacataatccccaaaatgccaaatgtttagagagcttttttttttttgagacggagttttgcgttttgctcttgttgcccaggctggagtgctatggtgggatctcagctcactgcaacctccacctcccaggttcaagcgattctcctgcctcagcctcccgagtagctggaattacagatgcctgccaccacgcccggctaatttttgtatttttagtagagacagggtttcaccatggtggccaagctggtctcgaactcctgacctcaggtgatccacccacctcggcctcccaaagtgctgggattacagacatgagccactgtgcccggcctagagagctcttcccatgaagagccatttcatgccatcatcaacaggctgccttcgtgggtggccaatgtgcttctggaaaaccagctgtgaataacgtgagcaactcatggtgtctacatgagaaggaaacttttagatgtccttattgactttcttcttggtattgaaggtggtataattattatagttacatagttttatctggaagaattacttgatctaaaaggtaatttaaaattagtaaaatttattagatatgaggatactacatatgatgtagaatcatagcccattctagaaataaaagcttcctaggtgtttaccaaattaaggaaaataaaaaacagggaacccgatggcaaattaaataatgtaaaatattagcatccagagaggaatcattttcaagatcacctaaatgactggctgagttttgtctttaaccaagaactttctactgagaaacgaagcccctgacaggggtgttcaagtgttattcccttagtagttagggcaggttattaatttagtttcgcctacaggcgctctgtccctatactgcgtggaagttaattagcattttaactctgaagctgccaaggtcggcaaaactgtaagctgctaacatctaagttgatgcagtatgatgtaatgtctgccagttttttccctgttagacttaattcctacaaaatattacaatcctaaaaaggaataaatgacagcatttgcaggctaatctcttattaagatgctcttttcaggttttacagaaacggccactttctcaatgaatattcaagaacatcgattaaaaagtcaaaacatgcatggtatatcttagactcccccacaagaggaaagtctattgtaaacaaaatcgtctttttcgggttgcaattccaaatatttttttaaggttcttcatgttcaggagcatgttctgcaattccacttccaaatattaccgataataaaaaaatacaaagttttccagacagcctagcgcaagttttaaaccatttgctgtacttacgtggatttcctgctcctacggggctccaagtctgagtggggagaagcagcagcaccttgaggacggcccaggccactgaagccatgctctcttcagccaggcgccctgagacccgggcaaggcgacggccgctctgcgtcgttcctgctctcactcccgctctcactcccgtcccctgcgcggctccgacgctgctctgtctcccctgtccagtctctagctctcttcctcacgcactggcagcctccctcggcgctgcagaccctcccgccaagccgcgcccggccccagctgcgtctccgaggtcggccccgcggactcgcgccgcagctttctggagcgctcggggccgcgcggcgccgccccaggcacggaggcggcaggttcaggcgcgtcccggacactaggcgcgggaggcggccggcagcaacgcgagtcaagaagcgagcgggagggacgccccagctccgcctggcgctctcctcccgttataccggcagcttcctccgtccctctctcccaccggggcggggcggccgcggtgcacggactcgtgccaaagaccgcgccgtcagcctccgcctgcaggtggagaacgccaggctttatcactctgctgttcacccaacgcaggggctgcacccaggaaaatcctgtcctgtttgagttcaaatagggaagatggggcagaaataactctgcggcgtgtactcgggcagacgcgcgcacactttgattttgctaggaattctgacttgtagagaaccaagctgggaaaccgggccaggagcagggagaggccggtgagcctgggttgtgcgagtgcaagcctttatttaaagttttaatattttgtctatcatgggttttttttctttgcgattacattcaattttaaaactatttcattcattcaggattagcgttacttaacagttgctcctgagactagtgcgttagtcccttcaccctagtcctggccttggtggaagtctaaaatttatgttttattccagctttctgtccaaaagagcaacccctgcaagtgtaggatgaggagctcagtccagcagcagctaacactgcactccttgcgcgcctgctgtgtgctagagagaggggcagaggcgggaggcgggaggcagggggcgggggggtctttctctttttctcttcctctgcttctcaaattcacagtaggggcaaagattgacaaactcactcacattaccaccaccgcgagtttccaaaaaagaaaaaagaaagaaagatactaacttttttagatggtatctctaagaaatagtgtattaatcttccctttggaaagacaactttgaaaggctttttcattaaaatgaattcaaatgtaatagatgtaaaatgtaaaatgaattcaagtgtaatagatgaagaaacttacaaagtcattcttgaattataaattgggttcacttaaactacttttgcacaagaactctgtaaatagcacgtcttttattacagaaaaaattataaatctaaagttttgattgacagatcagttgccttcagtgagacagagagaaaatggaaatcattttctaaattggacctagagtaaaacaacaaatgtcaatctattattataccaatttgtcaggcatcagatggagtctttaaaaatgtgaacttggccgggtgcagcggctcatgcctgtaatctcagcactttgggaggccgaggaggccaagaggtcaggagatggagcccatcctggccaacatggtgaaaccccgtctctattaaaatacaaaaaattagccgggcgtggtggtgcctgcctgtagtcccagctactcgggaggctgaggcaggagaatcgcttgaacccgggaggcagaggttgcagcaagccaacattgcgccctgcactctagcttggcgacagagccagactccgtctcaagacaaaaaaaaaaaaaaagtgaacttgggtgttcaaagtgttaggcttaatggagaaaggacaagaaacttctacggtggtagacatttgcaattaaaaaaatggcttcattaaactgtaaaatcactagcgtagtgagggtgaatgcattttttacaacattggaggaatatgtttatgaatattattcccaatacataaaatatacattttacacacttataggtacactcaaaatttgttccaagttgttcatgtctagtaaacgtatatacactattttatatggttaagccaataagcatcagcattttcttctaagacaggaggcttgtaattgttttgattcccctgcttttgacttaaaacttatttaggtttattctacttaagttgtttggttaggggacttgaagtccttagacataaatgtgtgtcttgaaatgcattttatgtggctataattgctgctatatggttattatttaaatcagcatagacacttgctgtggtgataatgctgtcaatgaactttgcagactaagagtagtgaggctctaaaaattactttgcctaatagagaagcatccgtcacaatcatcacacactacacacttactgaacaaatgaaggcatgaattcgagatggccgatgtaactagaacactggatgtcctagaaaaaatgtcgaatatcacaaatataaatgttttatgtgttgctgctttatttcctttcttccctactttccatgataatgcaatttaaactttgaaacttcttacttaccttctatttaaccttaacatggataataaatacaattatattttttatttcaatctggataatggttgcatgattcaaccagaataaaaaaggaataagatctactttgtaatagcacatatttaggaagtgagtatatttatattggaacaaatgatgatactgaggtgtgtttgatgactagcttctggattataagaatgtaaatgtttgttaagatagactcttttgaaatttgttcttgaatattttgaattacaaaaggaacatttttaaaagaattgtataaagaaaatgttaataattgccactaccatcaccccaaccccactgaggtaaccaatgatacataacaggctgacaggctagtatgtatccttatgtatccttgttttggctcttcttctgcttctttttttttttttttgagacagagtctcgctctgtcgcctagactggagtgcagtagtggtgtgatctttgctcactgcaacctctgcctcccaggttcaagcaattcgtgtgcctcagccttctgagaagctgggacaacaagtgagtgccaccagacccggctaagtttttgtatttttggtagggacaaggtttttccatgttgcccaggctggtctcgaacttcctgagctcaagtgatccacctgccttggcctcccaaagtcttgagattacaggcgtgagccatcacacccggccttggctcatatataaacacatacaacctgtacgtagagttgtgcttattttgttttaataaggttttaccttgtactttatactctcatcctgcaattttatcatctctctttgtagtataccgtgtgcattccagtctaagctagaacttagttttcagttctagaaaatagagtgagaatacaaaaatataacatttgcctgccaatctaatagcattttaattcctaaatagatctactttcacaaatatgctacttctcaaagaattatttttcttatgatatttttctaagcaatgcaatgtgatattaatcagatttttaaaatgcactactgcattagtcaaggcccagaaagaaagcatgatttgctcagatagtttaaaggaacaggctgtaaagaaaagtgaagggacccaccaggtgaccttgtggcaaccaaagacaagcactagcagaaagcctttaccacctacagcagaggcgcggagggaggaacggttgctgccagatccccagaaggcagcagccagggaacacaaaggtctggcaggagccgcagtcatagaagtaaaaaaatttgttgtcagaacctggaaacaggagtgagtagggaagaaactttttgagctctgacttctgaaaccttcctgtttctgtgggtgtctctcattagccaaaaccaactggaagtcagctgggaggggagcagggtgacactcgggcaggaagggtgacactggggctggaagggtagagggtggttctgaggacctccacaaagaatggccagcacatcctagaacactgacacttatcaaatttaaaaaaaaagtttatttttgttttgtgcattcatgttctttaatgaatgatttataaagtaatggcttggaatagaaatctaaagcttttattttttaaattatgaaccgaagtaatcgtacttgctagaaattaaaccagagctttgaggtcaaatagtttactctttcttctgtttatattaacagggaagattaattgtgctgaatatcgtagttttgaatggagctttttattaacttcaacatcaggaaatcaccagagtccacctacctttccttatttttcacagaaatagaaagattgatgttctcatagagcaaaaacgatgaggtctcacttcttgtggccttctgacatccatcaatattttaggaaaacaattctcacatttcagggccaaatgggaattaagttgagctcaaatacaaagggaaatattttttattaaaacattataaatttttttgtgaaatgaatcaggtagcctaaaatttaatccttccaaactacagtaggttaaaaaaaacaagtgaatgaatggtaaacaagttgaaattttctttccagtttcttatcactggctaattgggaagaattgaaaagtcagaagaggagaaaattataatcaatgcctactccattaaaaaattgcttaactgttttattgaaattgattctatagagagtccctgattgcatatttgataaggaacattaacgctaatacatgaaataccctatgtggtcacatatgaaagaaacattcttggctgggtgcggtggctcatgcctgtaatcccagaactttggaaggccgaggtgggtgaatcacgaggtcaggagatcgagaccatcctggctaacatggtgaaacctcgtctccactaaaaatacaaaaaaattagccggatatagtagtgggtgcctgtagtcccagctactcgggaggctgaggcaggagaatcgcttgaaccccggaggtggagcttgcagtgagccaagatcacgccactgcactccagcctgggtgaaagaacaagtctctgtctcaaaaaaaaaaaagaaagaaagaaagaaagaaacaaagaaagcattctcccaaatattttcgtttatataaaaagataagtctcaccctaaatcaatgttaaacttatagaaagaacaggtagtcacagttagaatgtgattttaggggctaggaaatcaaccccagacttcagcaaatcaatgttctaccactgaagtgtgctaatatttagtatgaaaccgcttacggatttcagatcttttcctgaaagcaaactttaatatagcagaagtcatctggatttgggctggagatggggagaatgagaggaggcaagtactataaggggtggagtgtaggggtaggagagagtaaagaaaggcattaattaaatgtcagaagtgaatttattcattttgtagttttatctaaactgaaaactgatccttgcttgaatggcttgatagagaatgcctctctcatggggcaaggataaagctataattataaaacttcaagcttaaaataatgggactcaatgtttgggacatctttttaactcagctaatctaaggatatgagaaaatactgttcctatttaaggagcaaaaattggtagatatgtgtttgggagaatttttagatttgccagcatttgtgtttcagaacactaaacagcctcatggcaagcctgaatttctgaatataatgaagcagagactgttttgtcttgagtagatccagttcgtgaagtctcaggggaacagcatgcttcatgcctgccagcagatgagcttcaaagtgccttaaggaagcactttgaccagaaggtagataactcttattatagaagaagaaggagtgtgtaattcatctcctactggtaagaatagttattgcttttgcaaacactgtaaatgtgcaatctagaagctagaaataagtacgcagttagaaggcagtcttttttttcatatgtagtgaaactactacactttctgcagtggcaaatcttagcagagattgtaaatctaagcagagaggtatccaggattgtggtagtctacactgagtatgcctacatgatggtagagaaaaaaaatgaagattacatgcaggatagctccctaagaatatcagataagaacttctgcagaacaacttgttatgcatcttctggtccaaattttcaaagaaactgctgccgggtataaggatacaaaaaaagagagagagaaagggagaaaacaaacaaacaaaaatgaccctgaagtgataaaatatttggctgcatttgttatttaggaaagtctgtaactcagaaatgagatggtctggagggagactttagaaacaatagcaagacacgaaagttctctcgaaaccttggatcccatttttcataataaacagaattatgtcttttttgattagcttgtgaaaattatttgagaataatttatgagaagttcccactgctaaaatatactgagttcaataaattattcatattttattttcattaattaaaataaacccaaatcctattaagaactttttcaaagactgataaccatgactacaaaatgctttgttgtcacatttcttttcattccataaattaaatagactcttctttgtctctaaaggctatttaaatatattatgtttcccaggaaaggctgcagttaaatgttggcattttgtccttatgttcctatagtttcctgttgtagcagtgtagaatgaagttatgccagaacaatttccacataaatattgaataaagtggacttttcatggttcaaagagttttgtgccaatgtttcttttcttaagtgttcaatgtaaatttatgaaattttaatattctctcataaacacctaagtgtagttgccattaaatacagattcacattcatgttagaactgctatttttttgtttcatatgatttgttcttttttttttttttccgagaaggaggcttgctttgttgcccaggctggagtgcagtggcgccatctgggctcattgcaagctccgcctcccgggttcaggccattctcctgcctcagcctgctgagtagctgggactacaggcgcccgccaccacgcctggctaagagtgtgtgtgtgtgtgtgtggtgtgtgtgtgtgtgtgtgtgtgtgtgtattttttttttttttttgagacggagcctagctgggactacaggcgcccgccaccacgcccggctgtgtgtgtgtgtgtgtgtgtgtgtgtgtgtgtgtgtgtgtgtgtgtgtatttttttttttttgagacggagtctcgctctgtcgcccaggctggagtacagtggtgagatctcagctcactgcaagctccgcctcccgggttcacgtcattctcctgcctcagcgtccggagtagctgggactacaggcgcccaccaccgcgcccggccaattttttgtatttttagtagagacggggtttcaccatagccaggatgctctcgatctcctgacctcgtgatccgcccacctcggcctcccaaagtgttgggattataagcgtgagcctccacaccccgccggcaaataaattttaaagccctacattcttgggcaaattttacccttaaacaaaaattcagccaattgtactaatccaataaagagccgttttagggagcctaaagttttttatgaaagctctagttgaatcacatatcaaagtactggtctattaagtttctttttttcagatataagttaattttgatgtattttatttgctctttaaaaaatcacacttttgaggctgcgtgcggtggctcatgcctgtaatgctggcattttgggaagccaaggagggcggatcacttgaggttaggagttcgagaccagactggccaacatggtgaaaccccttctccacaaaaaatacaaaaattagccaggcgtggtggtgcatgcctgtaatcccagctccttgggaggctagggcacgagaatcacttgaacccaggaagcaggggttgcagtgagccgagatcgcaccactgcactccagcctgggcagcagagtgagactttctcaaaaacaaacaaacaaaaagtcaccattttgaatgcttagacactactggtggacatgtaaattagttcagccagtgtcaaaagcagtttggtgatttctcaaataactcaaaacagaattactattctacccagtaatgagaatggtagacctaggcatgtgtatgttcattgcagcactattcacaatagcaaagacatgggatcaacctaaatgcccatcaatggtagactgaataaagaaaatgtggtgcataggccgggcgcggtggctcacgcctgtaatcccagcactctgggaggcggaggccggtggatcacgaggtcaggagatggggaccatcctggctaacacggtgaaaccccgtttcaatttaaaatacaaaaaattagccgggcgtggtggtgggcgcctgtagtcccaggtactcggaaggctgaggcaggagaagggcgtgaaccccagaggcggagttttcagtgagccgagatcgcaccactgcactccagcccgggtgacagagcaagactcccgctcgaaaaaaaaaaaaaagaaagaaaatgtggtgcatgtacaccacagaatatactacacaaccataaaaaagaacgggatcatgtcctttgcagcaacatggatggagctggaggccattatacgaagcaaacaaacacaggaacgggaaaccaaatgccgcatgttctcacttatgagtgggagcaaaacactgagtacatatggacacaaagaagggaacaacaggcactggggcctacttgagggtaaagggagggaagacggtgacaactgagaaactacctatctagtactgtgcttattacctgggtggcaaaataatgtgtacaccaaacccctatgatgtgtaatttacctaacaaatcagcacatgtacccctgaacctaaaataaaagttaaaaaataataacaataatcaccctttaaacctatctttcaacatttgaagtttgcaaaggcaaagttttattcacctatggaacatggtttactaactgagcaactctgggcaagtactctcttggcctcttaagtggggataataacagggcatgcctccaaatcttcctgtgaacattaagtgaatggatacgtactggacactcagaaaaatgcttgggttgtagtgatatttaagtgccattataatggcagcattgtatgaacagaaattaaaaacttcaaagtacatgtgaaaaaatatttttaaaaaatctaatcattgtatgatataactagaaattttatttaagtacttaaagtaagaatatttctacttaaaattctagatgcagtgaaaaaaacattaaaaaatgaaaataaagacatttttcagacttagaaaacctgaaataattcatctccaacatagccactttacaataaatgttaaagaaagtttttaggcagaagaaaattgaaaaactgatactagatggaaatataaatgcatacaaaggactgtgggacactggacatggtaactacatgaataaaactctggaatgtttttcttattatttaagcatttttaaaatataattgtttaagtaacagtaataacaatatagcatgaggtttataacacatgtagaagtcaaatttatggcagtgatggcacaatgcctatgaggagaaaaatggaagtatgctattcaaaaattttatatgtgaagtaatatactataacttgaatatacactgtgaaaagttaaaaatatatgctacataccctaaaccaaccactaaaatatgccaacaaagagtaaaggctgataagccaatcaaagagataagatgaaattcttaaagaaattctcaattatcctttaaaaagggctaaaaaagagaaaaagtaacaaagcacagagggaacaaatgaaaaaccattttaagaaaataaacttaaatctaaccatattaataatcacattagtatcaattgcccaaaaactctaacatttacagattagattcaaagaaagcaaaagctaacagtattctgcctccaaaaaaacatactttaaatggaaaaacacaagtaaaaagacgaaaaaatatataataaacactacctcaaagaaatctggagtgactatagtagtatcacacaaagtaaatttcagttgaatgggtattactagagataaagtcatttcaaaataacgaaagggtcagtttgtcaagagaaataaaaaacctaaatgtttatataacaaatcatgtacattcaatatacatgaagcaaaatataaagattataagaaaaataaacatttttctttccacaattacagttagatttttgtttgtttgttttgagactgagtttcactcttgttccccaggctggagtgcaatggtgcgatctcgcctcactgcaacctccgcctcccaggttcaagcgattctcttgcctcagcctcctgagtagctgagattacaggcacccaccaccacgcccagctaattttttgtatttttggtagagatggggtttcactatgttggccgggctggtcttgaactcccaacctcaggtgatccacctacctcagccacccaaagtgctgggattacaggcatgagccaccacgcctggcctagtcagacatttttatacccctatatcaaaaacttctacaacaagaagacaaaaattcagtaagagtgtaaaagatttgaccaacattaccacttgacctaattgacatgtatagaaaatttcaaataccaactgtcagatacacattttttttaaatgtacacagaatatttacctagaaaaaaacatatgctggggcataaaattaatctcagtgatgtcagaaaaatggcagactagaaaactttagaactttgtcccccatggaaacattaaagaaaaaactacaaattggttaaactgacatttaggaactatggaaaacagctcaaggtttacagaaaacacatgaacatccaaacaaaacggagccacatccaaagcagtagaaaattgtgtggcatttttacttggctttgccacatcccatccctggaactgcacagaatggtcttaggaaagtgatagctgagcttccaattccttccctggaactggaagggtaaaccagactttatttgaaatgttctaacctgtctgggagctccatgttggattagtctccgttgtttctaactcataggtcagacagcaaagatcagaacagctcatatctcaggctatgaaaaccaatgagagacaacagacatagctcgtgaatgctgctgtgagatgcatgatagacctgcaaatgcctggagcatgagattacagatagaggaataaaatagaatattcttgactctgagaagaagcagggctatgacccctagggaaattaagacattttctaaaaggctgtatacacaaggaaaaaataaataaaagcacacacaggcccagagaaaatgaagtctgataaaagaccacagaagatgaaagccttcagaccaggctgatctaagtcaaagaacatgcccttctaattattgaagagcttttcctacacagactcagtctgcaaacattgggagaggaaatgcctttttttctaaatgccccattttccacaataacaataacaataacaataacaaattacaaggtgttcaaagagacaagaaagccatggcccaatcaaagaagaaaatacagctgcagaaactgtccctgaagaaacattgacatttgaaatactagacaaagacttttaaacaactatcttatgctcaaggagctaaagaaaaacatagacaaataactaaaaagtgaagaaaataatatatgaacaaaaggagaatatcaacaaagagacagaaattattttaaaagaaccaacaagaaattctggagatgaaaaatacggtaagtgaattgaaaaatttatgagacagctttaacagaagactagcaggcagtggaaagaagcagcaaacaaaaagaaagattatttaaaagtagtgagtctaaggaccaaaaaggaaaaaaaaaaaaaggaagtgaatagagtctaaggtatttaagagtcaccattgagtagtccaattattcattacagaagttccagaaacagaagagagaaaggaggcagtgatttatatgacaacataagtgtcagaggcgttcaaaccagagcgactccattttgagtgagggctaggaaaatgaggcagagacttgctggactgcattctcagaaaattaggcattttcctagcttctagatgtttatgaatcagtgaacaaattaatgatgcttactaaaacagacccagacttgggagtgtccagatatctcaatatctggagaataagggcattcctaattttgcattaaagataataatattgattcttgcaaaatatggtaattaagaaaattaatcctttatcaaaaactcttgtaggagagcacatctccccatatatgcaaccatcgtacctaggatggatgtgttcttcctctcactttcaggaatgtcctactctgtctatggagtagctgttctttcaccacttgcttttactttgcactgtggactcgccctgaattctttatcgtgtaagctctaagaaccctctcttggggtctgtatcgggactcctttctggtaacataaggatcaaaaatttcccaaatttttaagacatgtatatgcaaatccaagaatctcaatgaactccaagtatgataaaacaaaaggagtgtaggcagaggaacaaaattgtcaactggaaattttataattagcaaaactgtccttcaaacatgagaggaaaaccttctggttctaaaccagtatgtaaggagcttgatagtcatactttatcctaacaactagtaaaaagttgaacaaacaaaaaactcaacacctcttctcagatctgtcatggaaatgagatcagagagcaaaccaaggacccccaaattggagagacagacaggcagatacatagaagcaaaacttaactcatgcagaaatgatgagcagaaatctccataagacccagtgttgggttgggcatagtggctcacgcctgtaatcccagcactttgggaggccgaggtgggcagatcacctgaggtcaggagttcaagaccagcctggccaacacggtgaaaccccatctctactaaaaataccaaaattagctgggcatgttggcgggaacctgtaatcccagctattcaagaggctgaggcaggagaattgcttaaagccgggaggtggagattgcagtgaggcaagatcatgtcattgtactccagcttgtgcaacagagcaaaactccaccaaagaaaaaacaaaaaacaaaaaaacacacaaaaaaaaatcaccagtgctgaagtagaaaaacctgaaactgtaattaacaaattgctggagctcaatgtgaacaactctgaaagttaaaaacttcaagtgggtacactcattgaaggtctccatactattgtgaattatgcctccagaaactctactaggttctcagtgaatgttggaaaaaatgtcctcatgcttctggcaggaggaaggggaaaggaaccatttggaaacatgctggagtattcagttctttttcacaagacctgcaccagaagaaactattttactagggcctaatctgctggggttttatcagagcctactatatgtgacagaaggaaaatactcaactggctgtagccttccacatgcacaaaagggaataaataactccatctccttctggcctttcatgtgggggaagagaaacactcaactacaatcccttttagatttccacatggaaaaagggaaatatacaacttcatcctcccttcagccattatgtctcatctaaagtcggggaggaactgagaagcactgatgaagttcacagtcaaggggcacagtctcaccaaaagactgagccctaatcataggactatagaatgctccccttccccttacactctatcactacattactaaaggcctatttactatagctgcttttacttagtacattgtgttcacttttcaacaaaaaaaattccaagatagactgaaatgcaaagaaaaaaacagtttcaaaagtatgaataagcatcataagcagagtcaagtatggcaggaatgttggaattatcaaagcagatattttaaataattgtgattaatgtgctaaggactctagtaaacagacaacatgcaagaacagatgaattatgtaaacagagagatggggatacaaagaaaaaaatcaaaaaagaagtgctggagatcaaagacattgtaatagacataaagaagggctttgatgggctcattaatagactggacatagccaaaaaagaatctttgagtttgatgatatgataatagaaatttccaaaactaaagagcaaggaaaaaaattactcagtaaaaacagaatagaatatcaaagaactgtaacaaaactacaaaaggagttaatacatatattgggaattttaaaaggacaggaaagagagaaaaaaatggaagcaatatttgaaacaataatgactgaaaattccttccaaactagcgtcagacaccaaaccagagatcaagaaagctcagagtacaccaaacaggatacatgaaaagaaaaattacacctaggcatttcatattcaacttcagaaaatcaaaaataagaaaaaaaaagtcttgaaagaagccagagaggaaaaataccttacatataaaggagcaaaaataagaattacttcttaaattttcttagaaaccatgcaagcaagaagagtgaggttgagagaaaaaccaccagcctagatttctgcacactgtaaaattatccttcaaaagtaataagaactaaagttcttctcagacaaacaaaacctgaaggcattgttactggtagacctaccttgcaagaaatgttaacggaagttcagaaagaaaatgatgtaggtcagacactccaatctacataaataaaagaagagagtcaaagaattaataagtaaaagtaaagtaaaacattcatttttttgttcttaattgatcaaagacataatagtttgctcaaaataataatagcaacaatatatggttatgtacgcatatatatatgcttttgcatacttttgtgtacatgaagtgagagatagcaatgataaaagggaaaggaaggaagaattaggaatattgtgttattaatatatcttctacctgtgaagtggtatagtgtcatttgaaagtgtacttggattagttgtaaaaatatattgcgaactctaggactaatgttttaaaactttaaaaaagtataattgatatgctaagggaggagagaaaatgaaattatataaagtgctcaattaaaacacaaaaagtagaaaactatgcgcgacaaaaataactaagagcaaggacggcaaagaaaaatcattaacacagatggtacatattaattgctatatcaataatcatcttaactgtcaatggtctaaaacacaccaattaaaatacagagactgtcatagtaaatcaaaaaacaagacccagctgtctacaagaagctcattttaaatttgaagactcatagagataaaaattaaggggatggaaaagatactgaggtaaattataaagggtggtcatagcctcccttaaaggagaacaaacttgctaaatagatggagagaataaactacccgacagtgcacaaaccacatcatgggctcagggttagaacatactgcagcaaggaggtagaaaaatagaagagagaattcccaaattcacacaagcacagaaacccatgattagtgtccttggactgacctatattcactataatagtaaaagaaaaacacccctgggtggagatttaagatgctaatgatacatgcaatgttaagtcctagcatgtacaaccacagcacctgtgcagccaggggactacccataacatactcatcagaacaccccttcccacccctccatgaataatcatgtaaatctcccataaagggcgatccccctgcatcagacagggctgtctcacctttgagcagcctgctctgatcagctgtcagagtgtacttttgctttgcaataaactcttttgcttactgttactttggactcgttctcaaagttttttgtgcagcaaagtcaagaacctgaaacagcccactggcaaaaatagcatgctaacagtaatccaaagaaagcaggagtagctctattaatgacacatcccacttcagaacaagaagaattatcagaaataaagagagtaattacataataaaaatgcggtcagttctccaagaagacataacaatccttagtgtttacacacctaaaaacagagcatcactatatgttaggcaaaaactaatagaacttcaaggaaaaatagatgaatttactactgtactttgagactttaacatctctctactagtaattagcagattaagcaggcaaaaaattagggaagacatattataattcaagtcagcagtgacattaatccaattgacatgtgtagaataattcacccaacagcagaatacacatgcttctgaagctcccatggaatgttcacaaagacacatcactatctaggccattaaaaagcaacttatttaaaagcatgtaagtcatgcaaattatgctctatgactacagtgaaattaagctagaaatcaaattcagaaagatgactagaaaacattcaaatacatgaaggcgtaacatcacacttctaaataaaaaatggatcaaggaagtctcaggaggaattgtaaaatattttgaactaaatgaaaatgaaaatacaactttaaatttgaagacccatagagataaaaattaaggggatggaaaagctactgcggtaagttatagagggtggtcatagcttttcattttcgcttacatcttacgaaagtgtgaaatgcagtaaaacaatgcttagaccaaaattatagcattgaatgtacatgttgcatcccaaggagggtctaaaattaataatctaacttttcaccttaggaagctagtaaaggaagaacaaattagactcaaaataaggagaagaaaaatataaaaatcaataaaattgaagacagaaaaatcaatagaaaaaaatcaacaaataaaaatctgactctttgaaaagataaataaaattggtaaatctctatccagagtaagagagaaaaagaatacaaattattaatatcaacatttaaagaagaaccacctctatagatactatggacattaaaacatttaaaaaaataaagaaatattattaacaacttcataagtttgataaccgacataaaatgcagcacttctttgaaatatacaatctactaaaattcacaccaggagaaaaagacaatctgagttgtcctatacctatcaaaggaactgaatcaataattaataagctgataaaatagaaagtaccaagccccagagagttctctggtaaattctaacacttaaaagaaaaattataacaattctccagaatcttttccaaaaaatagaagcatacagaatgcttccctagttattctatgaggtcattattaccatacaccaaaaccaaagacattacaagaaagaaaaaacaaagagcactatctttcattaagcaaaaatcctgaacaaagtattagcaaattggatccaataatgtgtaaaaagatgatgaagtggaccttatcctaattatgaaaggctagttcaacaattgaaaataaactgatatatttcatcacattaacaagaaaaagaaaaaaaacaagatcacatcagcagatgcagaaaaacatttgacaaaatccaacatccattaacgataactctcggcaaattaggaatagagggaaacttcctcaaagtgacaatgtctataggaaacctacagctaacatcatattccctggtaagaagttagatgctttcctggtaagatgaaaaacaaggcaagaatgcctgctctcaccttactcaacatcatactgagggtcctagctaatgcaataaaacgtgaaacacacataaaagttaaacagatttggaagaaagaaataagactctgctcacagatggcatgaaggtttatgtaaaaaatccccccaaaatcaaccaaaacatttgtggaactaacatgtggttatagtaaggttgtagaatataatgttaatgtacaaaagtcaattgatttctgatataccagcaatgggcaattggaatttgaaattaaaagcataataccatttactttagcattgaaaagagaaatgtttaggcataaattaaataaaatacgtaccaggtttatatgagaaaactacaaactctggtgaaagaaatcaaagatctaaataaatggagtataaatagaataaaatatgtacaaagtttatatgagaaaaaactacaaactgatgaaagaaatcaaagaagatctaaataaatggagagctattctatgtacatggataagaagactcaatattgtcataatgtcatttcttcaaaacttgatctgtagatttaatggaaccccaatcaaaattccagcaaattattaagtggatatccacaaactggttcaaaagtttatatgaaatgacaaaagatccagaacagccaacataatattgaaggagaagaacgaagttcgaggtctaacgaactaatttctgtatgattccaactacatggcattctggaaaatgaaaaattacagacacagtaaatagctcagtgattgccaggagtttgagggaaaggggactaggggtaaattgaacacaagagattttcagaatagtaacactgttatgtatgacagagtaattttggatacatgccattatatatttgtccaaacccatggaacgtcaatcacaaagagtgaagcctaatataaactatgggctttagtaactaatggtgtatcaatactgggtcatggattctaacaaatgtgccacactcatgtaagatgctaaaaataggagaaactgcagggaggtatacgggaactgtttttttctttcatctttttttctgtaaacctaaaacttagtaaaaaatgaagcatcttattttttaaaattatctaaatacattaataaaaagtgagagattagcaaagtagatttcaaaatatcctaatcataagctgtttataagaaacctactttacatttaataaaataggtaaattgaaattaaatgcatgaaaaagacataatatgcaaatattaacaaaataatgcaggaatggctatattaatatctgatggagagacttcagagtaaggaaaattactaaagacaaagaaagatattacatatttttaaaagccaagctactatgaagacacaatgatcctaaatgtatataaaccaacagaattttaaaatacatggagcaaaagcagagaatactgaaagaagaaatagacaaatctacaattatagttggggattccaaccttctcactagctgacagaattactagtcagaaaattcgcatagatatagaaaaatatgaactacacagttcaacaacaggatccaattgatattcatatatagatttatcacataaaggaaactccaataagattaaaaactaattgctcatcataagtaatagaaggcagaagaaagtggaatgacatattaaaagtgattaaagaaaataagagaccaagaatcttatatctagcaaaactatatgctaagacttaagattaaatagacattttctggctgggcgtggtggctcactcctgtaatcccagcactttgggaggcagaggtgggtggatcacaaggtcaggagatcgagaccatcctagctaacatggtgaaaccccgtctctactaaaaatagaaaaaattagccaggcgtggtggcgggcgcctgtagtcccagctactcgggaggctgaggcaggagaatggtgtgaacctgggaggcggagcttgaagtgagccaagatcgcaccactgcactccagcctgggcaacagagcaagactctgtctcggaaaaaaaaaaaaaaaatagacattttcatataaacaaaaattgagaaaatgtgttgctggaagatttatcttgatatttattaacactaacaaaagatttccaagctgattcctgatacgtgttcaaccccatatgagaaaacaaagaggctggtaaattgaattatgtagataatttttagagtataattggatattttgtcttctttccttaaatgatttaaaatgcaattgcataaaatgatatgtatatacacagattgttggattcataacctatggaaatgtaatatatttgacaataatggcaaaaggatatgagcaaatccatattggaccaaccaataggttgacaccagatggtttttcaggtgtacaaaaataaagagaaccagaaatggcagataagaagattaatatcacaaactttacaaatgtatacttgccctcctttcttcctcagcttctttaaaagatgcaaaagtaaaaagaacaaagctggagacatcatgctacctgacttcaaagtatactataaggctacagtgaccaaaacagcatggtactggtaccaaaacagagatatagaccaatggaacagaacagaggcctcagaaataacaccacacatttacaaccatctgatctttgagaaacttgacaaaaacaagcaatgcggaaataattgcctatttaataaatggtattgggaaaactggctggccatacgcagaaaactgaaactggaccccttccttacaccttatacaaaatttaactcacgatggattaaagacttaaacataagacctaaaaccataaaaaccctagaagaaaatctaggcaataccatccaggacataggcatgggcaaggacttcatgactaaaacaccaaaagcaatggcaacaaaagccaaaatagacgaatgggatctggttaaactaaagagcttctgcacagctaaagaaactatcatcagagtgaacaggcaacctacggaatgggagaaaatttttacaatctgtccatctgacaaaaggcgaatatctagaatctacaaagaacttaaacaaatttacaagagacaaacaaccccatcaaaatgtgggcaaaggatatgaacagacacttctcaaaagaggacatttatgcagccaacaaacatatgaagaaaagctcatcatcgctggtcattagagaaaggcaaatcaaaaccacaatgagatactatctcataccagttatgtgatgcttttttgtttgtttgtttgtttttgtttgtttttgtttttttgagacggagtctcgctgtcgcccaggctggagtgcagtggcgcgatctcggctcactgcacactccgccccccggggttcacgccattctcctgcctcagcctccggagtagctgggactacaggcgcccgccacctcgcccggctaatttttttgcatttttagtagagacggggtttcaccgtgttagccaggatggtcttgatctcctgaccttatgatccgcccgcctcggcctcccaaagtgctgggattacaggcgtgagccacagcgcccggccatgtgatgcttttataaagcatgctttcttgcgtgccgctatgattgtaagatgtgactttgctcctccttgccttacaccgtgattgtgaggcctccctagccaggtcaaacctctttcgtttataaattacccagtcgcaagtatgtctttattagcactgtgagaacagactgatacatcagagataaagaaggacatgctgtaatgttaaagagacaatatgtcaagaaggtataaaaattataaacctatgtgcactgaacgaaatttttccaaaatctacaaagcaaaaattaaaggtagaattaaaggtgaattaaaggtagaattcaacaataatagttggagatggtaatcgtagcagacatcagtatctcactttcgataatcagaaaagctaaatagatgctagcaagaatatggaggatttgagtaacagtataaactagctagatgacagtacagtacacccaaaagcagaacattactctcaagtgcacatggaacagttcctaaaatagatcacatgctaggccaaaaaccaaacctcaaaaaaagtagaaaatgattgttctttgatcaaagtggaattaaattagaaattaaaaacagaaagaactttgggaaaagcagaacttataaaaattagctacatacttctaaataaccaatgagtcagagatgagatcatgatgaaaaataagcagaagaaaggatataataaacactgaaatagaaattaaagaaatagaaaaaatggtagagcaaatcaacaaaaccaagagttgggtctttaaaaagattaacaaaattaacaaactttagctacacttacagggagaaagaaagattcaacttactaaaattaagaatgaaagagggacattactattgaccttatagaaataaaaagaactattaaaggtactatgaaaaaaagaatgtcaacatattagataatgttgacgaaatgatatcatttctagaataatatctaccaatcatttaaagaagaattagtgccattcttcacaagctcttaaaaaattttaatatttattacagtattacttataatagccaaaaagtaaaaacaaccccaatgttaattaactgatgaatggataaatacaatatggtgtatcatatatcgtatatatgatatcatgttattgaccaacaaaaggaatgaagtactaacacatgctgcaacctgggtgaaaatattatattcttgtaaatatcatgctgcataaaagaaaccagaaccaaagagtgcattttgtattattccgtttatataaaatctcccaaacaggcaagtttagacagtggttgcctaatgatgtaaggtggaggaggaatgggaagtgactgctaatgggtactgggactctttgagggtaccaaaaatgttataaaatgaaactttggtgatgattgaacaactgaatgaatatattaatatgtatgaaacattttaagtgagtaaattacacaaaatttaaattatggctaaacaaagctgtttttaaaaagtgtaccagcagcagaaaattagttataaattaatcaggattaaacagtgctcatcttgattaagcttataatggatgatgatttattttacttgttttattctgtagtaaacagtttgagattcagtgattaaacaaaggactacctttacactctacttattttttaagtaaaagaaaaacattattaaaaagtgtataaactggttcatgtttatgttaactatcttacccttccttctcttttacttccaattactttggttatgtttcgggttttatttgatattgtctatggaatctgttaatcattctttaaaggaaagaggaagtgggtagggaataaagtatggagccatccaaaaacgaaaagatctgggaagatgctgtgctgatttaatgttaagaaatgttcagaaagtaaacccttgatgtcttggtttttattttagaaatattatcttgttgacaatatactaaagtgcatacaactgatttaaaataaaaataaggtatatgaaaatatgtaagatgcagctgaagcagaggtgagaggaaaatttttattactaaatgtttatattagaagtgataaagtcctcaaccaactaaattcctacctcaaacaacaaacaaaaacaagaaataaaaagagcaaaataagaccaaatcaagaagcagcatattctggtataactttcaaattatcctttaaaaatagtcataagttcagaatctggtgtacaaattctatattatgtctccttacctttgaaatgcatttttttttttttgagagacaatctcgctctgtcgccaggctggagtgcgatggcaccatctcggctcacggcaacttccgcctcccgggttcaagcaattctcctgcctcagcctccggagtagctgggactactggaacgcgccaccacatccagctaatttttgtatttttagtagagacggggtttcatcatgttggccaggatggtctccatctcctgacctcttgatccgctcgccttggcctcccaaagtgctgggattaaaggcgtgagccaccgcgcctggcctaaaatgcgtttcttttccttgatataaatgtattatctgcactactatgaatactgaaatgccataattgaggctttttttttaactttgcaaatggaataaaggagagaaggaaggatgagagtctcctgagatatttagataaatgttagagaaaagaaaagattcaagttgatattctgataaacctgataaatcacatggacaaatctgacatttatgcgagtaaacgaaatggaaaacaatataactgggtgtaaagaaagaaggagataaaaaaatacaaagttaaatagtccctcatattggtcacaaggccaaatcagctggctcagaatgtcatttactgcagaaagcctcactgaatttcctcctttaaggaatgactttgttcctaggaaatctacactagtgtatagaaataaaggggcatactgtctgcatcttgctcttagataattcagaaaaatgtgtgtgtatatctatatcaatacctatctagaataaacaagtgtgatgatctgttaacaattgataaacctgggtaaagggtaggtatatgggagttctttgcatattttttcaacttttatgcacatgcgaaattatctgcaagtgaaaatgtttgtaaaaattaaaaaacataccatttcaaaacaggctgtatttatataagaagtgcccaatgtttttgcttaatttctttgtggtaagattttagtcttccaggaaaagtttcatattggttattattgtgaaaaataatgaagtggcctgcttctaatttttctaagttcccttttgaataactaagcatctacaccaaattaaagatacttctctataatttttcaaaattcaaaaaggatgtctcataaagtaagaaaataaactgtggtttgttcctccattgttgttaatttgcaatgtcccacttatctctgatgggatatcagtaaatttacttgccttattgtacttgttccttgatgtatttctaatgattaattagaaataattacacatttgtccactttggaaagtaatggaggtgaagggggtgtgtgtgtgcacttgtatggacgcacacatgcataggtacacacacacgtattgtgttttcttgttttgttttgtgctttgatttttatttttaaattgtaaattgacaaatcatagttgtgtatatttatggagtacaaaatgatgatataatttatgaatacaatttggaataattatatcaagctaattaacatccaccacctcaaatacttgtcatttttaatggggaatgcatttgaaatttactctcttagtgatttttaaaatgtagaattctttactatgtactattttcaccaagttttgcaatatatctcaaagaaaaaaaacccttattattccttttgtataaatgaggctttgtaccttttgaccaatatctatccattccaccccgcacctccagcctctgctaatgaccattctgctctctgcttctttcagtttgattgttttagattccacatataattgagaacatgaagtttttgtcttttttggcttcgcttatttcttttagcgtaacattttccaatgttgttgccaatgaaaaaatgatttttgtaaaggcatgtaattgtaacagtctcttatgatcctttgtatttttgtggtatcagttatagtgtctcctttttcatttctaattttatttatttgagtcttctctccttttttcttagtctagctaaaagattattggttttatatttttaagaaacttagttttgttcatcttttgtgtcattttctagttttcatttcacttatttttgctctgatctttattattttatttccttctgctaacattggaagaatttgatatcctttttctatttccttgaggcataatactaagttgtttatttgagatctttcttctttttgctgttgatgtttattgctataaactttcctcttagaaatgcttttgctgtatctcataagtttcggtatgttgtgtttccatttttgtttttctcaagatatttttacatttcttgtttaatttcttcattgacctattggttgttcaagagcatgttgcttaattcttttaattttcatttcttcattgacctattggtggttcaccaccatgttgcttagtttccacgtattcgtacattttctggaattccttctattgttggtttctagtgtcatatcattgttgtctgaaaaggtacttgatatgattctaatattaaatttgcaaagattcatcttgtggtctaacctgttgtctatcctgcagaatgttctatgtgtccctgagaagaatgtgtattctgctgctgttgggtgaagtttctgtatgtgtctattaggtccatttggcgtaaagcgtccttcaaggttaatgctattttctatcttttttttttttttttttttgagacagaatctcgctctgtcacccaggctggagtgcagtggcgcgatctcggctcactgcaagctccgcctcccgggttcacgccattctcctgcctcagcctccccagcagctgggactacagtcgcccgccgccacacctggctaatttttttgtatttttagtagagacagggtttcaccgtgttagccaggatggtctcaatctcctgaccttgtgatccacctgcctcggcctcccaaagggctgggattacaggtgtgagccactgccccggtctgtttagaagtatttttaaagaattattgcacttctgttcggatagaaaaacaaaaatacatttttagaatatatatttatatgtatgaaaatataaaattttgaaaagttgaatatttcaagccaattatgtagatgtccttgtccttccctgagctgctgactcacgttccatgaagcgggatgggtctcacaggcctgtcaggatgcaggctgtgatgtgaaggccgctcgacgctcacaggattggacgggtttgtgaaggaatttgcagcgagccttagttagctccttaacatttcctttgagcaacatcagtgcttttgacgttttgcactactgtataaaactgtaagtgtatgcagagatgtatgtttctgaataaatcacaaaattgacaagcaactgccatgcattgttttttgtatcatagcttactgataaagtacagactgcaacatttacttattcaaatacctttaaagatctggtatttttttgcttctacttcccaggaatttgacctcagggacattttctattatttccatatctattgaaatgaactcaaatcaaaaatgaggatgtttcattatacatttaaaatgtgagttttcccatttaaagtcacgcaaactgaggttactatgaaaaagatttaaaattgtgcagaatgaatcactgaaaaattagtttattctaaagatcatatagtcagagtaaatatatttaaattttattactttcagagtaaatatatttaaattttattcaatttcctctttgtcagcaaattagtgaataacattactgatatcttagatgtttgtggacacaaagagaatagaggtaaaaatcatgaccctcaaagagctcaaaatcctaagatttttatgggcagccccagaggtataaaattcaaaaggacattacttctccattcctgattaggtacgcaatgttctgggattatgcatggctcttggatccttgagagtaataatgacagtgatctctgaattaacatagttcaacttttataataattatggccttcaaccatgtgaagtttgtggagcactgagatttcttggggcgattttgtaacagctaattcttaacagcaatgttatttcaggctttttggccattccctgttacaactgctgatcttttattcctataatggtacagaattctttgagaaaaataaattcatcttttcattcatttaaggaaaaattgtcagcacgagcctatggctataatgttctccatcatttaaagaataaaaggaataatctggttgaaattgaattatctaagcttatatatggttttgattcaatggttaatgtgcatttttaacaagtgatatggtttggctgcaacatttacttattcaaatacctttaaagatctgttttttttttttttttttttttgcctgtacttcccaggaatttgatgtcagatgcattttctattatttccatatctattgaaatgaactcaaataaaaaaaggggatgtttcattacacacttattaatgtgtaatttaagattaatgtgtaatcttgtaattcccataatccttatgtgtcaagggtgggaccagatggacataattgaatcacaggggtggttttctccaggctgttcttgtgatagtgagttctcacaagatctgacggttttataaggggcttcttccttcactcagatctcattgtttctgctgccaccctgtgaagaggtgcctttggccatgattgtaagtttcctgaggcatccccagccatgtgaaactatgagtcaattaaacttcttttctttataaattacccagtcttgaggagttcttcataacagcatgaaaacagactaatacagtaaattggtaccacagacatagggtgctgttataaggatacactaaaatgtggaagtgactttggaactgggcaacaggcagaggttggaatagtttggagggttcagaagaagacagtaaaggctgggtgtggtggctcatccctgtaatcccaggactttgggagaccgaggcaggtggatgacctgaggtcaggagtttgagaccagcctggccaacatggtgaaaccccatctctactaaaaatataaaattagctgggcatcgtgatgcatgcctgtaatcacagctacttgggaggctgaggcaggagaatggcttgaacatgggaggtggaggttgcagtgagcagagattgcaccactgcattccagcctgggcaacaagagcgaaactccatctcaaaaaaaaaaaaagaagacagaagaatgtgggaaagtgtggaacttcctagagacttggaggacttggaagacaagaagatgtgggaaagtttgggacttcctagagacttgaatggcttctaccaaaatgctgatagtgacatggaaaatgaagtccaggctgaggtggtctcagatggagatgaggaacttgttgggaactgggataaaggtgattcttgctatgctttagcaaagagactgcaacactttgcccctgccctggagagctgtggaagtttgaacttgagagagatgatttagggtatctcgtggaagaaatttctaagcagcaaagtgttcaagaggaagcagagcataaaagtttggaaaacttgcagcctgacaaggcgatagaaaagaaaaacccattttcttgggagaaattcaagccagctgcagaaatttgcagaacaaggagtggaatactaattaccaagacaatgagggaaatgtctccagggcaagtcagagaccttcttggcagcctctcccatcacaggcctggaaacctaggagggaaaaatggtttcatgggcccaagaccccctgttctatgcagctttgagacatggtgccctgtctcccagatgcttcagctccagccacagttaaaaggggccaaggtacagctcaggccattgcttcagagggtccaagctccaagccttggaggcttccatgtggtgttgagcctgtgggttcacagaagtcaagaattgaggtttgggaaccttcacctggatttcagaggatgtatggaaatgcctggatacccaggcagaagtttgctgcaggggcaaagccctcatggagaacctctgctaggacagtgcagaatggaaatgtggggttggagcccccacacagagtcctcactggggtactacctagtggagctgtgagaagagggtcactgtcctccagaccccagcatggtagatccactgacaactttcactgtgcccctggaaaagccacagacactcaatgccagcccatgaaagcagccaggagggggttgtaccctgcaaagccacaggggtggagctgcccatggccatgggagcttacttcttgcatcagtgtgacctggatgtgagacctggaatcaaaggagaacattttggaactttaaggtttaatgactgccctattggatttcagacttgcatagggcctgtagcccctttgttttggccaatttctcccatttggaatgggtgtatttacccaatgcctgtgcctccattgtatctacaaagtaactaacttgcttttgattttacaggctcataggtggaagggacttgactcagatgaaactctggacttggacatttgggttaatgctgtaatgagctaagactctggggaactgttggaaaggtatgattgtgttttgaaatgtgaggacatgagacttggaggggggccagggacagaatgatatgatttggctctgtgtccccacccaaatcgcatcttgaattgcagttcccataatccccaagtgtaaagggtaggatcaggtgaacataattgaatcatggggtagttgcccccatgctgttctcatgatggtgggtgagttctcatgagatctgatcattttataaggggcttcccctttgctcaaaactcattatttctgctgccaccatatgaagaggtgccttctgccatgattgtaagtttcctgaggcttccctagccatgtggaactgtgaatcaattaaacctcttttctttataattacccagtcttggatatttcttcatagcagcatgagaatggactaatacaagatgtgagtgcatttccagttaataaataggtaatattttctgtgttttctgctatggtaatgaattgcattacaacttcactaaagagagaaatcactcacaatctgagacctaaaccaagagctgaagaaagtgcaaagagacctacagtaattcctataagttatttccaatggaaggcctctgtgtatgtagtactgtaatagaaaaacctatggaataaaaagaatgcattctctgagtaatgttatgcagtttaattaacccttctctgcatatttttggcagctgtcatctgtattatagggataatacaattaatggtactgtcatgattacataagtgagatgagtgaggcattttttttgttttttgtttgtttgtttgttttgagacagagtcttgctctgtcgccaggttggagcactgtggcgcgatcttggctcactgcaacctgcaactccctggttcatgtgattctgctgactcagccttctgagtaggccattgtgtgtgtgtgctgaggggttcccttattgggcaaaatgtacagggtagcaagggatttttggcagcaaaggattgtgattgggtggggaggagtagtaatatttcatgagaagtaagttgagaagcaaacgagtgctgtgtgttttcattaagtaatagggtcgacacagcatgggaacatacacatcaagtgggcggcctaacactaaatcagaagtagcctggatgagttggaagtcatggccactgtttgtaggccaggaggatatgctttagcactggctggttttgtgggaaaacagagagaaagacatggctgagtctcagggtgctcagagaaggccacagccttggggtgccgtggtgaccacaaacacttcccccatcccataccaatctttaagagccttttcctccttaaaggcctgtcacttagcaaagagctttcaatgaaccctcccctctgggccacttgttggattgcagccaatcagtgatggagggctggacacaactgtgggatgctgtgatttggtttggctcctgggtctagagtgctctggggtccactgtacttctgggataaaacgccaaggccatgactctcttgctaatttacaaacaaaagattgagggctagctaaacaaggacagagcggaagcagctttctgtaagacacacccaccagtgtgccctgtcagtttaccattgccatggcaacactcaggcattaccacccctttcagcggcaatgacctgatgacccaaaaattaccaccattttcctaacaatttctgcacaaaccatccctgaatctgcatgtaattaaaagtaggtatacatatgactgcaaaactgggctcagccactactctcgacaccctgcctatggggcaaccctgggagcagtcactgagctgtgaccccacaggagctgtaacagtgttgctttgataaaggtgttttcttccaccttaccactggctcgcccttgaatcctttcctgggtgaagccaagaacccttgcaggctaagccccgctttggggttcgcctaccttgcatcagcatcaggttcgttttttaaacttgtaaaatactttttgtgattctgtcatgtattttgcagtcatgaactaacattttttttcctcaattgtcagttgcagtttcctcaaagatcattataaatactccttaacctacaaagtttggcagtcacagcctgctcttcgaggaacagcctgactcaccatcaagcggctcctcaggtggttttacttcccatgtttcccatgtgaggtactatgcctcagtgattcctggcaaaactaggattctctgttagtattgtgctaactttggagtgagtttcttttggtgagtaataattttagtcaatgatactactgattattttatctttttttaggcttatgatgaatgcttgatttatgattaatatgtttttcacttttacacatttcaaggaaggaaacaagaacagacagaaacacaacatacttcatgaaaccacattttagcatcctggccgagtattcatcagtcagcaagatagagagacataaactatttccagcaagaatacttcataaatgatgaatagaagaaaaaaagaagtcctaaaaatcttgcagaactgccttaatttactatctttacactgtatcctaagtcactctctagcttcttgctctaagcatatgaaatgtaagagctaatgggaaccccagtgcctgtataaataacaagaaccagcatgtctttatttatggcagggaacactctacaacctgggacaaatgccactctgcttcagtttggggaagctcctcactttaccatcctgacgttgaataaatgattcaaaggcaactacagatgcaacctgagccactggatgggcttttgtaaataaagttatctcacctggcattcattacagagaaaacaagaaataaggcactacatgtcatatttgtctagatcctatacctatttaggttcacattaaaatgaagagaaaacaacataggctgagaatcagaaaacctgaactctgtcccagctcagccactggccacagggaattaaccaatctctttgaacgtcagtttcttcattaagcatcgtagagaatgtcaaaaccaactttataaatactgtcattccaaaaccacacaattcaaatataaataatctttataaggtaaaacaaaaatgtacataatactttacataaacatttttagaataagtttattataactcgataagcaaaataatccaaacctttatacatttctacaaggatagtcacgtatgtcaatttttcggtttcctctcgtgcctattttgtctcctgagccggcccctttccagctgacacgtgtgctccgtgttctcccacaatagcctgacctggcctgagtccgcgcccctgtgagcctcctttctttgcttacaacagcagcctgcctgatgtcagttatggactattctttctttcagcctcatttcagggtcctctgcctcttagagctgctgctgtagcttagctagagacccgctgctgttgcatcatggaaaagtgccacatacgttcacatgtgaaagaatacgcagaccttcatgttgtgttttagttttaaaaaaagtcagaagtagcttcacttgatttcagcttgtaaagacataggagggaggcaactgagaatcaccgttgcaaaaagcaaacatcaaaaatcacattaaaatgctgaagtgttgtggatcacaaacctagctttattggatcaagcattcgtgagagttcttctacttgctttgttatgctttctatcagacagggctcattctctgtcttttttttaacatattcatttttttcctttggtgtgtttagattattatcacatcttatgttttaaaactagcaaaatatgtgtaagtcatgaagacagcgtaagaaataataaaatgaacactgatgtacacattacctgcctaagaatcaaaaactacccatatttttagagtccttaacactgtcctgttaattagtcccatttcttgtctttataattttgccaaaataaatgcattagtaaaggacattgaacattattgttttacatgtttttcagtttaaacaaatgggattacactgaatatatttttctgaaattgctttttggttcaatattaaatttgtaagattcattcttatgatattcttatctgtactttctgtgcattgatttagagtattccttcacaggataatactataatgagcattccattttattagattggggttattatccatttttttctgttacaaaaagtagatgtccttttcttgtatgagtctcctggacataagagttagattttctctaaggtataaacccaacattcaaatcattgtgtcaaaagatttgtacactaagttaaaatgaactgttttccgatttatgctcccattagaagttaaaggttctgatagatctatattctcaacaatacctaatagtatcacagttttttttttttttttttttttgagacagagtctcgctctgtcacccaggctggagtacagtggcgtgatctcagctcactgcaagctccgccttctggtttcacaccattctcctgcctcagcctcctaagtagctgggaccacaggtgcctaccaccacgcctggctaaattttgtatttttgttagagacggggtttcatcgtgttagccaggttggtctcgatctcctgactttgtgatctgcctgccttagcctccaataatgctgggattacaggcatgagccaccgtgcctggccagtatcacactttttaacattagttaacttggtttgtcattggaattttaatctgcattttttagaagtactgaatcaagaaaaaaatcaagtaatgaaaaaaatgttattttagtaaataaaaatgctataaagacaataaagcaagtgaacgtagtcaaaagcggagaggggctacttcattttgatagtcaaagatggccttgctggtcatctgagttgagaggtggctggcaagatgagaagagatgttaagtagctgtggaaggggcctgctggcacagggcatgctctaaggccctgaaaagaggcaaacattctttccctctaaatacctgaactaagtaaaaacagtcctggatttgcacatttgaatatgcacaggtttaattaacatagtttagttaaatagcactagtctcccaaaaacgtggttacaatttcagttaccacaatatgctaactgtgagcaactgcataaaatccaaacttcattcccagctcttaattccacaaatgcctatgtgagtaaataacaggcaagcatcatgattagggactgtattaatcttgtggggatgctgcaacaaagtatgaaaagccgggttgcttaaaacaacagaaatgtattgactcgtagttgtggaggctagaagtcagaaatcaatgtgttggcaggttcacgctctctgctggctctaggggagaatccttcttcccctctccttcctgtttgggtttgccagccatccttggtgttgtctgatctacagatatatcactctgttttctctatgtgtcttcacatcgtcttttttgtgtgtgtgtctggagctgtatccaaattctcctttattataagacaccagttagtctattggattaggacccaccctaatgacctcattttaacttgagaacctctgtaaatgtgctatttccaaataagatcatattattttgagatattggggattaggatttcaaacatatctttttagggggacacaattcacctccttcaaagcctgtcagtgactgctcactgtgcatctgctagttcgcacacagacagcagagtctgcaatcgtgttgactccttgtctcccagtgagaaacccatgtgacatttataaatatgaataatcagaagaaaaaactggtcaacaaccattgatgtgcggcaaagaaataaaaaatgtgataaccctggaagtgtattcaaatacaatgtaaatggaatcatagaattggctcaccacaggaaacgcagcaagaggaacttggcgcaacgcagtgttctgacataaatgaggaacgcagctgtgatgaaaaggatgaagaagccccagaggaagtgatgccggcaaagacagcaacaaacttcatattaaaggaactcttgtagatattgcatgacgttgacaatgttagatgctgttccgaaaacagcacgacagttcaccaaggcatagaaacactgctggctccttatcataagctatacgacaagagggaggcaagcactgttcaaactgggcttgatacacgtctataaataaataaagcactttaattggctgttgtttaatgttttaaattacagtgtaaaaatgaagtactcccaaccaggcacggtggctcactcctgtaatcccagcactttgggaggctgaggcggataatgaggtcaggagatcaagatcatcctggctaacacagtgaaaccctgtctgtactaaaaatagaaaaaatcagcctggtgtggtggcatgccacaactacttgggaggctgaggcagaagaatcgcttgaacccaagaagtggagcttgcagtgagccgagatcgtgccactgcactccattctgggcgacagagcgagactccatctcaaaaaaaaaaaagtactaatttcactatgtttcatttccttatacatttataaccaacagtaagagatttttaatgttttggccaaaatttttaaatgacacagaacagtcgatgtttcacatggattatttaggtcactttacagatctttagcttacatagtgatttgtatggccctgcactgctgtgcaaagagaggactgtctgtgttcttaaccagtaagaaggagggcaagaaagaggttctcagccagatattgcgtatgtaataaaatgatgggagagggaatagcactttagatatgaaatgtaccctgtggggaagctatttgaacaacaacaacaaaatagcttaatttaacctgatggagtacactcagccaccttctagatgtccctgcttattcttcaaatcttctcttttgtggccccaaagaatgattcactctctggagtgaaaaataaccgttgctttctttgcctggaactttaaactgacttgtgctgtatcatccaaacctgttcaattctctcttttctattactcagtgaggtccaaaggagccaaagacaaatctctcctgtttttcttcgaaatgtaaagatgttgcatctgtaaccacaggctgcttttaatcctaaaagtcagcgtgataatgaaatccagtgattaatttctgtcttctaatcaataagtagacatatcaatttatagtatgttagaaagcctcaactccactgaaacaaaaagcaagaggctctgcaaatgttggagtgtgctaaaggaaaagcatggactgatgtttggggaaaggttggtcaatgtgatgaggccatctgtgtttgctaatagtgcttatcaaagttaggttcctacacagagacagagaccaggagacaatcctgtatccttcttgatccttatagtccaaagggatagctcctaagtctttgagaaagacattctgtgttataggagatttaaagggacagagaaaaggtttataactacaggttttctgtgtttttttgtgtttttttttttttctagacggaatctcactctgtcaccaagctagagtgtagtggggcgatctcggctcactgcaacctccgcttcccaagttcaagtgattctcctgcctcagcctcccaagtagctgggactacatgtgtgtgccaccacgcccaactaatttttgtatttttagtagagacggggtttcaccatgttggccaggatggtcttgctctcttgacctcaagatccaccttcctcagcctccgaaagtgatgggatttgagccaccacgcctggccataattgcaagttttctaaagttaaggctcttagaaatgggaggtcaggggcctatagtcaagttttgggtgggacaaacagtaaattcttttggcagaattgaatgttcccaggcaggtgctttagaggggtatggggcatcgtagggacgtggctctgagctgatagaggctgtgttggaatttggccaagtcccttactgtatgtatgaggaggagggatgtgcagaagaagttgtttgtgccaagaatttgcggttttcacaggttaagacagcggtgcctgggatcatctgcaaggcatgagtcaaatgttgacacaatgattgtttgcagactcatctgagggcttaggcagatctggacctgttgatactgaagtttctgaaggtagaggaagaaaatataatgtctcaataatatctgaagtaggggtagggaaacagagatttaaggaggtgagatcccttcaggcctcagaaagaagcttcacttcttgtgcctctcttcagaataaatgggtcattaaattagttctttgtaactaacctaggcatgatggtgaagaagggaatagtgagaggaagaactttaaataaatatgcctgagagatcatactagattaatgggagagaaagaaatttccaagaagctgtcatgggaaagggctcacgaataataatttaaaaattagttattgataatatgaataaatcaataaaaataaataaaaagagatctgccaatagccacacttacagcaccagatagattttaaataaattaaaatttgagtttttaatgaattttctacaatccaaaatttatttgtttaatttttgcaacgaaacaccatttctttactttttgcaaaagtaaaagtaagatgctacttgtactttttaaataaaactaattttaaagaaaaacataattagccagatgtggtggcaggcacctgtaatcccagctactggggaggctgaggcaggagaattgtggaggttgcagtgagcccagaaggccccactgcatccagcctgggtgacagagcgagacagtctcaagcttcttcagtgctcacatgtaaacttctactttccccttcagattacagcaaccatcatgccaaagctatacactctcagggaatccctgtggatttcactgatgaccacttgaccaactatcataaagatcaaggccaggggttctcaaactctcaacatttgtgtgctcatctccccttcacccagagactccccagggctgctgggccacactttgttttgtttgactggaacatagtttgaaagggatggaaatttccaaaaggtgttaatagacacataaagatttttaaatattaaaaaaaagaaaaagaaagaaagaaggaaatgggcatttgtgaactttggtcatgagaacgcaggcctcgcagtacttaactactccttccaaacccctgcccaaagagaggaccaaactctagtgaggcttccagcagcacaaggatgtcccacagatgaccccagccctccttaaaatgactgcctgagaaagctcacttgcaaggagaatttactgtttgtttcaggcaaaacctggtgatgggcaggtagagccccgaatcccctcttagaaccttagaaagcttgcaattataaatcttttctctgcctttgaagtgtaaatctacatcccagaattgtctcctcaaagacctgagagctgtctctttgaaatgcaaacattcaggaagctaactcttgctcttgttgccagttcctgagggaggggaaaggcctagctttggcaagcaccttgctccagcttgcacctctgactcttttattgccatcaaaatcaacatgtagacttttttcaaacccaatgacagcccattacaatggaggccatagcaatggaggtctctacatgcaacaaaaatggtgggacagtttcctgacaacagtccaactttattccaaggataagcatgtcatgaaattattggatggcagattatgcttatctatggtcttcctttttctccttggtctcatcccaataacttacagatcctttaaaggcaaaggccaaatattcagctaagttaggcatactttagatgccaatatcaattttagctatatgggagattctacttaagatattgaggacgatcatgtgtgtacagggcaaaaaagatgggacaaagagataaggggatgggaaatcgcaccctccctccgcaccacagaccatgacctggggcaggtcctctaacaccaagcccacccaggccccatctaacagtatgccgcattctacatgacctcagagttctttcggaattccagctgaaaagctgaaaagcaatactatatagctgtggtttccagctggcccatgttagtatgtatagcttttcttcctcaccatgaaagcactatgggagaacgaagcccgatgctgagcatgctttgccaggtgggtgctgctgaatcacagacctcagcgactgtgttccgcctccacagaggccggagatgtttgtttccccagtgtgttcatatatttcagccagtgtcttgcactttgccctctcagtttgcttcactttctggctcagtgaacctgacctgcaagtctccctgcagtttccctcagcaagtgctcactgggcagccccaacatgtgagaaacggctgtagggtgcacagaggtgaactaaattactgaaaactattactttactaaaatgcttcctggattccagaactcaccaactgggagaaaggtcagacacacacggagacaactcatctacacaaatgatcatcagtgatttaaagaaggtgcaggagatcatggaataagaacaagaagagattactttccagggctctcagaaagtttctgaaacgaagtgccattgaccctgaccttagcattgtgatggagacattacagagctggtaggaaggagaagaaggaatggctggaacacacttggggtgaaatgagcggcatttcagtgtgggagctgcagactcggttttggtggaagagttaggagccaggatcttgtcaggaataattctgtgtccaagtgcagaatcgtggtttgctccattactgccagtaactccatttctcaatcatgatggtgatgcttttttttggctctcaatcccggagattggccatactgaagtcacattacaacaattaacttttcaactattagttgattaatttttaccaagtagcaagaacagctgtttggcacgtagcagtgtggcatgagtatcttgtaaatgaattaaacaaaatatctctccagcacacacacagtcattcttgctgcatgtcagcctccacttctccctccattatttgatgccgtgaagctgaggcagccagcttgagcgaaagttttcagatctcactccaacaaagagctttgattgattcacttagtataaggtgttttatctagctaaagaaatccaagctgagttttattaattactaagaaaaatatctgtgcaatagattaatctttgatcaaaactatgtgtgaagtagaaacatattacacatatggagagcaatattatggaataaaaacaacctatgtgtggcataattgacattgtctttatattttggggggggctgaatacgcagtctcgctctgtcgccaggctggagtgcagtggcacgatcttggctcactgcaatctccgcctcctgggttcaagcgattctcctgcctcagcctcctgagtagctgggattacaggtgcatgctgccacacccagctgatttttgtatttttagtagagacagagtttcaccatgttgtccaggatggcctcgatctcctgacctcatgatcctctcacctcagcctcccaaactgctgagattacaggcatgaaccaccttgcctcgcctataaataatttttgaaacagatacagaatatatagatagcttaacaattataaaattgtatttatcaagtatgtcacgaggtaaacattttacgctatgcaaaagggagcaaacctccgaatttgtcatgcagggtcactagtggaactcacagcaacaggtgtgataaagcagaggagggaaccaggcttccatgtgctttagagagagtgaaacatgaggagtcacaggcagagaaaactgtttttcagaaagaaaagaaaggggacatgacagcccagcagtagggtgaagagggcctctccgtgggtgccactggcttgagctgctgtaagtggctgtgcctggaacagaggatctggataggagaatggggaagggagtgctggaaccggggttgggcaggagcagcagtctggagaccagaatgacctagggtttcctctcatgctcccattcccagtgtttcacgtgtgtaaagtagcaagcatgtatatactgcttagaggcatctacacttacatactacactcatatccaacacttgcatcgtacaaagtacacatagtaggtgtggcatgtaataagttaccctcctatattttcttctaaaagatttttaaatatttgcatctcaaatttaagtcctttgtccatttagatctggcctttgtgtgatagggatccatttttgggatagagatgcattctgatattttcccatatggataccaattgctcataccatggttcatatagaccctttctgactgttctgtaatgttagccagggcatacatcaagatttcacacaagcatacactttcacaatagcaattcctgctgtggtaattataacttcacagcaaatctggtacgagatagactcacataagctccacctcccaccttcgcacactttagtcttctatgggattgtcttagttatactgggcccttttctcttccatataagctttggaagcagtttagtgacaatggtactcttgtctttttcttgattttaaaaggagtgatttcaatatttttaatcacaaaacatgataggtgctgtaggttatttgtcgactccttttatcaggttaaggaagttaccctttattcataggtggaaatatcaataatttaattttcgtaaatttttttttttttttgagagggattctcactttgtggcccaggctggagtgcagtggcaggatctcggctcactgcaagctccgcctcccggattcacaccattcttctggctcagcctcccgagtagctggggctacaggcgcccgcctccacgtccagctaatttttttttttttttttagtagagacagggtttcattgtgttagccaggatggtctcaatctcctgacctcgtgatccacccgcctcagcctcccaaagtgctgggattacagacgtgagccactgtgcccagctgtaaaataattttataggccttttgagacaatcatataatttttgtctttaatttgttgataaggagataatttcagtagattttctaacactgaactaaatttgcattactaaccgagcttgttcatggtttttatactttgctaggtatacttcctagtattttgtttacactatttgtctgtgtgcatggatgaggtacaccatagcaaggttatcctagtatcatatgaattaaagaatggtctcttttttttcccctcgcagattattagtgtaacattggaactactggtgacatcatctaggcatcatgttttctttgtagaattattaattattaactcaattactttaatggtatgatttccatctagattttctaattatttgagtcaactttgatatgttatatgtatccaaaaatgtgttaatctcacttatttacaaatgcatatatatgtcttgttacttaatgaaatagatcataaatataaaagtgtgtgtgtacagcttaagaagaatataaaatgagcatatgcgcccttccttcaggttatgaaatagaatatttccagtatcttagaaactcccattgcccttcttcaatgccactcactctttccacaagaggtaaccactatccctaacttcctgttaatcattccattgcttgtcattatagacttgcatattgtttagttttgcacatgtttgacttttttaataagtgaaactgtgtattgtttcttgttttttttttctgagacggagtctccctctgttgcccaggctggagtgcagtggcgtgatctccgcttactgcaagctccgcctcctgggttcatgccattctcctgcctcagcctcccgagtagctgggactacaggtgcccaccaccacgcctggctaattttttatatattttttagtagagatggggtttcaccgtgttagccaggatggtctcgatctcctgacctcatgatctgcccacctcggcctcccaaagtgctgggattacgggcgtgagccaccgtgcctggccaactatgtattgttacttgtgattagatatgcatacacacaaacatgtgtatgcatatatatatatatatatacatgtacacacacattattttttagagcagtttaaagttcacagcaaaactgagcagaaggtatagatttcccatatactccctgccccccacacatgcatagcttctctcatgataaacgccccccaccagagtgttgcatttgttacaattaatgatacatgatacatcttatagtttgcattaaggttcacactcgggcttggacaaatttacaatgacaagtattcactattaaaatatcatacatgtactttcagggccctacgcatcctctgtgctctagttattcattcctctcttcctcctaactcctggaaaccactgattttttttttctatctctatagttttaccttttccagaaaggtcatatagttggaagtgacagtatgtagccgttttagattggcttctttcactttgtaatatgcatataagcgtcctctgtgtcttttcgtggcttgacagctctttttattttttattttatttattttatttttttatttttttttagagggagtcttgctctgtcgcccaggctggagggcagtggcgtgatctccactcactgcaagccaagctccacctcccgggttcacgccattctcctgcctcagcctcccgtgtagctgggactacaggcacctgccactgcacctggctaagtttttgtatttttagtagccacggggtttcaccgtggtagccaggatggtctctatgtgctgacctcgtgatctgcctgcctcggcctcccaaagtgctgggattacaagcgtgagccatctcacccggccaacagctcatttattttatcattgaatgatattcaattgtctggatgtaccacagtttgttaattcacctactgaaggaaatcttgcttgtctccaagtttttgcaattataaataaagcttccataaacatctgtgtgcaggtttctgtgtggacataagttttcaactcctttggatatataccaagaaacaagattgctgggtcgtataataagagtagatttagttttctaagaagccacaaaactgttctccattttgtatttctatcagcactgaatgagagctcctgttgcttcacatcctcatcagcatttggtgttgtcagggttctggatttttgccattctaatacacatgcagtagtatctcattgcagtgctgtatttgagaatgtgaatagctgcagttcattcactcttagtgctgcgaggtactctattatcggaatatatgatcatttagttacccagtccactatctacccatattgagagataactagattgtttccaggtttttaaaattgggaacattctcatatatctctaggtaaacaaacgcaagaatttttctggggcctgtaacaggctgactaggttgcactaggttgtagtgaagtcactgggtcatagggtacattatgatcagctgtatgagccagcatctgtctgttttccaaatggctgtcctactttagtgtgtgggatgaatacttccatggttctttatccgtgccaataccacacgtttcagaacttcaaaaaaaaaattgtcaatatgtgtgaaaggatatctaattgttaattttcattttcatgattattatgaggttgagcactttttacatgcttatggggtatttgtgctaacttctcaacagacatgttatttttcacttatttataggaggcatattctggataccagacctttctaggtaagatgtgttgcaaatagctctgccaagttttgggtattttttttcacattgcagtatcctttaataaacagaagtattaaatttttgtgttatcaaatcaatttttcctctttcagtttgttcttcttccccatgtaaagataaaagatatggccgggcgcggtggctcacgcctgtaatctcagcactttgggaggccgaggtgggcagatcacaaggtcaggagatcgagaccatcctcgctaccacggtgaaaccctgtctctactaaaaatacaaaaaattagtctaggcggggtggcgggcgcctgtagtcccagctactccggaggctcaagcaggagaatgtcatgaacatgggagaggaggtggcttgcagtgagccgagaccgcgccactgcactccagcctgggcaacagagcgactccatctcaaaaaagaaaaaaataattattcccaggtttttttctaaaaatgttgagaagctatctttatccgttaaaatatatttttatgtttgttctccgggattaagtttcaatttcatttttttcccttatggagatcagtggtcccagtgttgcttattgtaaaatatactatcttcacttaacaacaatgaaagctgtgttacaaaatctgtttcccagtattagtgcaaaatatatttctctttatgattgtactcagattaactagtttgcaggactgtgtccagagttggttccttccggtgggttcgtggtctccctgacttcaagaatgcagctgtggaccttcctggtgagtgttacagttcttaaagatggcacggaaccaaaaagtgagcctaggaaggtttattgctgagagcgaaagaacaaaacttccacaccctggaaggtgaccccacctggttgctgctgctggttgcgggtggccagcttttatccccttatttcttcccacccatgttgcgtttctgtcttatcagagtgcccttttttcaatcctctccactattgactacttttagaatcctgctgattggtgtgttttacagaggctgattggtgcattttacaaattccttgtaggacaggaaagttccccaagtccgcactcgacccaggaagtgcagctggcctaacctctcactgccagaggctaatttccatcctggtatttctcaggcccatagatagtgtgaattcaaatccaaaccaatatgtctattgacttatacttagaaattacctttttttttcttttttcttgtctaccctattgaaaccaagacaagcatagattttcactttcttcttatgggagtgggattttcctagccccacttaacatgcttctctttagaaatcctagatttatgcaggaggcattttagcctatattcctccctgcatgggcatcagtctctgtctcctgaattaggtgctcatggttctgggccaatagttcctgggagacaccccagggcaaatgccagatgagacactcacacctctggattcaaactttttttgctcttgtagatatctgaaaatttgccttactttgactcagcccatgcattaaagcagatgcttttaaatattttatgatgcatgttttaggaaagagtctgtctgggtatttcttcttttgatttgcattttgctttcaattcttctttcacactatcctaagcattaatcaactcgtcgtttatgtcagttagtacaaaacttcactatcctgttcattatcaccatttcattttgttctgcataggccagactatttatttaaaaatgtttaaagaaacctaaggccttaaaggattctttctcagggactctactgtttgtatttagagaaatgctcatttgttccactgttttactttcttcttgggtcacgctctttgatgactgccatcttacagaggatgacaaaagagggcccaggctgagacaatgatacctgcttgcccctttggattttattttcttagtgttctcaaaatattaataaaatgtcaaaaacaaattaatatcaccagaatgtgtgcctcacttaaaatttttctctctaacaagtttttgtttcctagttcctttggtaccctaatgtttaggtaaatagtctctgaggaaaggatgtgaaagtcatagcaaaatatatgctggacttgaatgaaaaatatctgtttcataaaagttaagcaggcaaccaaaatttaccttttttaacctaaattatctaaacatgtatttacatttctgcttcattaaaatatatttgagattgaatgctcctgagacagattttggaatgccctccctttctaaaatatattttttattttttgtggactaaacagttatttaaaaatgaacttaatgattgctaattagttatctaaatacttatttaaaaataaacttaatgattgctaattactcagttatttataatgcatttcaaaattaactttattgtctaaacctcttaacacaaatgtattaaattatgtaacagagaattggctatttttgttcaaatatctattcttgtcagacttaaaatatcactcagctatatgattaaaaatgaactacagtcattaaattatttcccacttatttgtggcatttctccatattagaggagacaaacagtgctctttgaatctttttttttttttttttttttttttttgagacggagtctcgctctgtcgcccaggccggactgcggactgcagtggcgcaatctcggctcactgcaagctccgcttcccgggttcacgccattctcctgcctcagcctctcgagtagctgggactacaggcgcccgccaccgcgcccggctaattttttgtatttttagtagagacggggtttcaccttgttagacaggatggtctcgatctcctgacctcatgattcacccgcctcggcctcccaaagtgctgggattacaggcgtgagccaccgcgcccggcccagtgctctttgaatcggatgacagttctattgataacggccatcagaatctagttacgcattattaattaggtcaaggcatgaataaaatttctcccttgtttccactcaaaaactacaagtatagttccttggtaagatgctccaaccatggctgggtgcggtggctcaagcttgtaatcccagcactttgggaggctgaggcgggcagatcacgaagtcaggagattgagactatcctggctaacacggtgaaattctgtctctactaaaaaatacaaacaattagctgggcatggtggtgtgcacatgtagtgccagctactcgggaggctgaggcaggagaatggtgagaacctgggaggtggagcttgcagtcagccgagatcacgccactgcactccagcctgggcaacacagtgagactccgtctcaaaataaataaataaaataaaataaaaaataaaataaaaaaaagatgttccaaccatgattggtgatgccaatcatagaagaaaagagaatattgagaaataataagacagctactttaaaccattctgtgcctgaacattttgatggcaatattggtcatattataaatttgaaaatataaatggtaatctaaattgactttagtctaccagtgattatgagagctttatctaagtgaaacacttgcatttttatttctaacatttttcagaaaatgtgaaactccgaccaagtgcagtggctcatgcctgtaatcccagctcgttgggaggccgaggcaggtggatcacaaggtcaagagatcgagaccatcctgtccaatctggtgaaaccccgtctctactaaaaatacaaaaattagctgggcgtggtgatgcgcacatgtagtcccagctactcgggaggctgaggcaggagaatcgcttgaacccgggaggtgaaggttgcagtgagccaagatcgtgccactgcactccagcctgggcaacagagcaagactccatctcaaaaaaaaaaaaaaaaaaaagaagaaaaagaaaatgtgaagctccttattattttgttttaattttaagaattccacttcctagataagcagaacatagagccaagtgctatgttctggttgtttttaatgagtatatttatgttctccccaatttattatttattaatgtctaacttcaattagatgagttgattacttttcatacaccattgactaaaggaaacctaattttacacgtaattcaaggggatctgtaagtaagaacattttaaaattaaaccaacacatgtgcattgaaaatcattcaaacagtttgatgggcaaaaaaccagtgaaaaccagaaacttttttttttccttccatagaccttggtcctgtttttcagagttagacaaggtttatcattttctttttttactatatgctattctcttgaactgtaaataatattatacaatcacctaattttgttttaacaattttaagtaatatctcttgactttttatgaacggtagagaatatagctcatttaccctactttcttcttctaaaactatatttccaatttagtctttaatatataattttatgggattttttaaaaatttgctttctctaaataatatacttacagtgcttaattctttgcttaaataatatactgtttagataatatatggtccatccaatttgaacaccactgattggctcagtaggatgtggagattagtgtacaacttccctcccctccaacagtccctgtcatagctttcgacttgtatcaaatttcgttctatgcttatattttcacattttatgtaaattacatcctattttgtaattataataaagtctgtgctttgttcgtaggttaattttgatcatggaatctcaagtgaattgacagcatcattattatgttttctttttttttcaaaccacagtcgcaggtggcgtgatttgatttgtgtgaaggcaatgaaatgatacacagatacaccgaagcctcccaaaagaatcctggttccaagactcaagaagatggattaatgtttttccattaattgttggaatttatgccattttttactatgtgccatcaattttaaagcacttctgaaaagacataacaatctaaatgagatggcattttaaattcataaaaatatagtattttcctcaacttttatacatttatgatgcattatttcttatttcccgggaattttactacctttgttttgaatgattaaaaaggaaacacagcacttttttcagcacatcaccaagatagcctagttaatattcttctctttctgaagtagttgaattgggatagacagcttgccaggcctgctgccacgtgtcagcatcgcatccctacattcagccacacttgcatctaacgaccatctctttcattaaatttcttttgcaccttttcttcctgaatgagtgcatgatacttaattttcctgtgcacttgcatgtctcaagaaggttttaattctttttgtattgcattaatattaagttaagtttataattgcaaaatgatttatactcagaacattgaagactcctttgttttgttacatcctgtcaaaatgatgagaagacagatcatcctttagggaaaaattggttttgattggtgtcagcctttccaacagcaatgctggagacaagaataaaatgaagtaatatttttcaaggattaaaaggaaaccaattttaatccttgaattatttgcagccacaatcttttaaatatgaaagcccagaaaaagacattaaaaagtaaggcctcaaaagttttatttcaaataaatccctttgaaaatgcttagaggtcatactccactaagaagagaaatacaccgtggtgttagaattgagggttccagaatcaatggtagtggtgtttatcatactctaaaaaataaatgaaaacataacatattgaaaacaaccccaagtaaacttcagaaagcacccccttagacaaagtgctgtcgtaacagagaaagcaaaccagaggtggcaagaggaagctagagcacttatcttgtttgctgagatgatattaattttgacacatatcagaaattgagaaaattaacataaataatgatataaccaccattacaatgttaaaaatttccagatttcaaacaaatagaaaaagatttgatctatagagtgaaaggtacaataggaaaaaataaacagtaaagaaagtatgaaaaatcataaaatgagatgacagaaataactcataatggaacaataattacataaatcaaaggttaagattgtcaggtaaaatttttaagtgtcaaaaaaacactcaataaaacttatcgaaaataaattagtgtaaaaaatatagcaggaaaatatgaataaaaagagctaggtccaatttttgataaaaatttgaattcaagttaataatatcctaaagaaggaaaaaatctgtagaccaatagagagaaaggaaaggcgcattcagacaaagaaaatgtgtacagaacacactagggatatcagaagaggctgctcatggccaggcatggtggctcatacctgcaatcccagcactatgggaggccaaggtgggtggatcacctgagctcaggagttcaggaccagcctgggcagcaagggaaaccccatctctaccaaaaatacaaaaaaattcgctagccatagtggcacatgcctgtggttcccgttacatgggaggctgaggtgagaggattgcttgagcccgggaggcggaggttacagagagcccagattttgccactgcactccagcctgggcaagaatgtgagacccagtctcaaagcaaaacaaaacaaaataaaaaagaagctgctcaagaccagactgagctcctagaccttgaactccagtcccacctcacaccctaaggttcctaaagaatcagtaacttagttcaccctaccccactcctgacttctggatgtagcacaagtttctaaacttatgcaaacagtgaggactatctattttgacaaaataagaaatggagtcaaggcaacatgtaaaagatatttttgccagttttattgattaacaaagaaaaattgtatatagttaaggtatgcagtgtgatattttgatatacatatacattgtgaagtgatgattaccacaatcaagctaacatattcatcacctcacctggttacctttttatttgtgtttgtgtggtggagaacacttgagatctactctttcagcaaatttcaagtatacattattattgactttagtcactatgctgtacattagatctccagaacttattcatcttataactgaaagtttgtactttctgacaaacattttttcttttcccccaactcccaggccctagtaagcactattttactctgttaccatgagtttgacattttcttagtatgcatataagtgaaatcatgcaggatttttttgcatctgttcctggcttattttacttaccataataaactccaggtttatccatcttgttacaaatggcagtatttcctcatttttaaaggctaaatgatattccattacatatttgtgtgtgtctgtgtgtgtgtgtgtgtgtgtaatacatttaaaacatccattcatctgtcaatggacacaggtagtttccataccttggctgtgtaaataacactgtaataaacatgtaagtatatatatctctctgagatagtgattttctttactttggatatatacccagatgtgagattgctggattatatgggagttccatttttaattttttgaggaaactccatactgttgtctgtaatggctgtaccaatttacattcccatcaactatcaactaagcacaagggtttctgtttctcaatatcctcagcaacatttgttacctttttactgttataaaagccatcctaatagatgtgaggtgatatctcattgtgcattttcctgatgattagtgatggcaaacatctttttcttaatacatacctattgtcaatcgtatgtcctttagaaatgtatctcttcaggtctgatatgctttggctgcgtccccacccaaatcgcatgttgaattgtagctcccataattcccatgtgttatgggagggacccagtaggagatagttgaatcatgggagcggttttccccatactgtttttgtggtagtaaataagcctcacaagatccgattgttttataagggatttcctttttcacttggctttcattctgtcttgcctgctgctgtgtaatatgtgcctttagcctcccaccataagtaaggcctccccagcctcatggagctgtgagtccattaaacctctttttctttataaatcacacagtctttggtatgcctttatcagcagcatgcaaacagatgaatacagtaaattggtactggtagagtggggtgctgctgtaaagttatccaaaaatgtggaaccaacttcggaactgggtaacaggcaggggttggaacagtttggagggctcagaaaaagacagaaaaatgtgaaaaagtttggaactccctagagatttgttgactagctttgaccaaaatgctaataatgatatggacaatgaaattcaggctgaggttgtctcagatagtgatgaggaacttgttgggaactggagtcaaggaaaatcttgctatgctttagcaaagagactggcagcattttgcccctgccctggagatgtgtggaactttgaacttgagggagatgatttagggtagctggcagaataagtttctaagcagcaaagcactcaagaggtgacttgggtgctgttaaaagcattcagttttaaaaggaaacagcataaaactttggaaaatttgcagccaaacaatgtgatagaaaagaaaaaccaattttctgaggagaaattcaagccagctgcagaaatttgcataagcaacaaggacccaaatgttcatcaccaagacaatggggaaaatatctccaggacatgtcagagacctttgcagcagtccctcccattacaggccaagaggcctaaaaggaaaaaatggtttcctgggctggattcaggggccccctgctgtttgccacctagtgacttgataccctgcatcccagctactctagccatggctaaaagggtccaaggtacagcttggactgtggattcaggtggtgcaagccccaaaccttggcagtttcacatggtgttgcgcctgtgggtgcacagaagtcaagaattgaggtttgggaatctctgcctagatttcagaggatgtatggaaactcctagatgtccagaaagaattttgctgcaagggtggtgccctaatggaaaacctctgctaggacagtgcagaagggaaatatggggttgaagcccccacacagagtccccactgaggtactgcctactggagctgtgagaagaaggccactgtcctccggaccccagaaaggtacagccaccaaaagcttgatcatgcacacaggaaggctacagacaatgccagtccatgaaagcaaccaagaggggggctatttcctgcaaagccacaggggtggagctgcccaaggccatgggagcccacctcttgcataagtgtgacctggatgtgagacatggagtcaaaggagttcactttggagctttaagatttgacaggcctgctggattttggacttggggcctgtagcctctttgttttggccaaattcacccatttggaacaggtatgtttacctgctccctgtacctccattgtatttggaaagtaactaacttgcttttaactttatgagttcatagctcgaagggacttgccttgtctcagataagactttggactgtggacttttgagttaatattgaaattagttaagatgttgagggactgttgggaaggcataatttgttttcaaatgtgaagacatgaaatttgggaggagctggggcagaatgatatgattcagctgtgtccctactccaatctcctcttgaattgtagttcccataattcccacatgttgtgggagggacctggtggaagacaattgaatcatgggggcagtttctcccatactgttcccatggtagtaaataagtctcatgagatctgattgctttataacgggtttccccttttgcttggctttcatcctgtcttgctggctgtcatgtaagacatgcctttcaccttccactgtgattatgaggcctccccagctacgtggaactgtgaatccattaaacctcttttttttggagatggagtctggctctgtcacccaggctggagtgcagtggtgtgatctctgctcattgcaagctccacctccaaggttcacgccattcttctgcctcagcctcccaagtcgctgggactacaggcacccaccaccacacctggctaattttttgtatttttaatacagacaggatttcaccatgttagccaggatgatctcaatctcctgacctcatgatctgcctgcctcggcctcccaaagtgctgggattacaggcatgagccaccgtgtctggccaaacctttttctttataaattacccagtctctggtatgtctttgtcagcatcatgaaaacagaccaatacaagatcctttggaattgtctgagttcctaatttatttggatattaacttcttatcagatgtatagtgtgtaaatattttctcccattctttaggttatcttttcattgtattggttgtctcctttgctgcgctgaagcttttagtttgatttactcccatttgtctagttttgcttttgttgtctatacttttggtatcaaatctgaaaatttattaccaataccagtatcaaggagcttttctccgatatttatatctaagagtcttacaatattggtcctttgttgaggtctttcatccattttgagacaatttttgtatgtacagtgagataagggttcagtttcattcttctgcatgtggatatccagttttcccaacaccatttaataaagagactaaattttatcattgtgtactcttggcaccaatgctagagatcaattgattgtaaagtcatggatttatttctttctatgatctctattctgttcccttggcctacatgtctgtttttatgctagtagcatactattttgattactacagctttataatttagtttggaataaggtaatgtgatgcttccacttttgttttttctgctgaaggatgttttgactgtttggggtcatttgaggttgcataaaaattttagaactgcttttttccatttctttgaaaaatgccattgaaattttgatggggttgctttatatctatagatcgcgctgagtaatagggatatgtatcttcttcaaattctttcatcagtgttttatagtttttggtatatacaaattttactgtcttatttaaatttcttcctaagtagttaattttttgatgctattgtaaatgagattgtgttctttcagacggactctcactctgttgcccaggctggagtgcagtggtgtgatcttggctcactgcaagctctgactcccgggttcacaccaatctcctgcctcagcctcctgccaccacgcccagctaattttttgtatttttagtagagacagggtttctccatgttagccaagatggtctcgatctcttgaccttgtgatctgcccacctcagactcccaaagtgctgggattacaggcgtgagccactgtgcccggcccgagattgttttgttaatttctttctgggatactcaactattagtatataaaaacgtaacaggtttttttttaatgttaattatgtgttctgcaaatttgcttgtttcttaattttaacagtttttaattggagcctttagaattttctctatatgagatcatgtcatcttcaaatagagacactttcacttcttttccagtttggatgccttttatttctttttcttacttaattgctctggctaggacttacagactttttcagaaaccccccaaaataatctaagggagtccattgtcactagacctgctttataagaaattctaaagggagttcttcaaactgaaatgcaataagactaattagcatcacgaaaacatatgtagttataaaaagtcaccagtaaaagtaactatacagtcaaattcaaaatattcctaatactgtaatgatggagtataatcactttaacttttaaaaggttaaaagacaaaaaatattacaaataaatataactacaaaataaacaaagaaataaacgctgacatcaaaaaaacataaaaagtggaggggagtaaagtgtagggttttgtatatgcttgaagttaagttgttatcaacttaaaatagaccattataactataatcatacatttcttaatgtggatatgttctgaataatgcctcattatgcaattttgtcatggtgtgaatatcatagagtatacttacacgaaattagataataccacctactacacacccaggctatatggtataacctattgcttccaggctacaaatctgtacagcattgtactatactgaatgctataggcaattataatacaatgataagcatttgtgtatccaaatgtatctaaacatataaaagatacaataaaaatgttataaccttacagggccaccgttgtatatgtggcccatcattgaccaaaacatccttatgtggcacatgagagcatatgatgttttatggaagcctcaggataatcacaaagacaaaacatgtaatagttacacaaatgaaaattttaccacatgtttaaaaaagaattaatacaaagacacagaaaagaatcaaagtataccactacagaaaataatcaaaataatcaaatcatgcacagcaagagagaaataaaagaacaaagaaactgcaaaatgcctatcaatagttactttaaatatcagtggaccaaattagaaaagacacagagtggctgaatggacagtaaaacaataaccaaatatatgccgcctataagagattcacttcacctttagagacacacatagactgaaaggaaagacagggaacaaaaaaaagaaagagtagctattcttacaacaaacaaaatagactttaagtcaaaaactgtaacaagagggaaagaaagtcattatagaatgatacaagggtcaattcatcaagaggatataattactacaaatatatattctcccaacattggaacacctaattgtataaagcaaatattaacaaatctgaagagagaagtgacaacaataatacaataacagttggggacttccatatcccactttcaacaatggattgatcactcagacagataatcaataaggaaacagatgacttgaactacactatagatcaaatggaccagacatatacgggacattactttccaaaacagcaaaatacacattcttcttgagcatacacagtacattctcctacacaggtcatatattgggccagaaaacaagtcttagcaaatttaagaagattgaaatcttatcaagtattctttttgaccacagtggcatgaaactgaaaattaaaaacaggagaaaacttagaaaagtgacaaatatgtggaaatcaaccaacacactcctgagcaaccaatagatcaaagaaaacatcaaaaaagaaataaaatatcttgagacaaactaaaatgaaagcacaacatactaaaacttatgagatgaagcaaaagcaattctaacagggaagtttatacaggttaagtgctaaatgaagaaaaaagatctcaaataaacaataaacctcaaagaaatagaaaagaaaaaaaatgaagcccaaaattagaagaaggaaggaaataacaaagatgatagcagaagtaaatgaaatacactagaaaaacaatagaaaagatcaatgaaacaaaaagctgattttttgaaaacataatggctgggcgcggtggctcatgcctgtaatcccagcactttgggaggcgggcagatcacgaggtcagagatcaagaccatcctggctaacatggtgaaaccccgcctctactaaatatacaaaaaattagcagagccgggcagcgtgcgcctgtagtcccagctacttgggaggctgaggcaggggaatggcatgaacccaggaggcagagcttgcagtgagcggagattgcgccactgcactacagcctgggagacagagccagactgagtctcaaaaaaataaaataaaataaaataaaaataataaaaattgaccaacctttcactaggctaagaaaaaagagagaagcctcaaataaataaaattagaacaaaaaagcagatattaaaattggtaccatagaaatacaaaggataataacagtctaaacaactatgtgtcaacaaattgtttaacttagaagaaatagagaaatttctagaaacatacatcccctaagattgaaacatgaagaaatagaaaatcaacacaaataatgagtaaaaatattgagtcagtggtcaaaaagctcctgaaaaaggaaaatccaagaccagatagcttagtggagaagtctagcaaatgtttaaagaagaattagtaccatttcttcacaaactcttccaaaagttgaagaggagggaatacaaacattttttatgaggccagcattaccctgataacaaagacagaaaagatactacaaggttgacagatatttttaaggtgtaaatgatgtattgttggaattgaaaatacaggatttgtttgtacaaagatttgtgtgtggataggtggatgcgtactggtgtgtgcatgcatacatatacaagcttaccttgttttattgcacttcactttattatgcttctcggatattgcattttttacaggttgaaggtttatggcaaccctgcatcaagcaagtctaccagtgccacttttctggtagcatgtgcttattttgtatctctgtgttacatttttgtaattcttgcaatatttcaaatgttttgttattattatatctgttatggtaatctgtgatcagtgatcattgatattactattgtcattgttttggggcatcacaaaccatgttccaaaagacaatgagcctaattgatacatatgtgtgtctgaatggttccatcgatctgcccttcctccatccccccaactcctcaggtctccctgttttctgagacacaggaatattgaaattaggccaattaataactctacaaaggcctctatgtgttcaagtgaaagtaagagtcacacatctcttatttaaatcaaaagtgagaaatgattaaggtgagtgaggaaggcatgttaaaagctgaaacaggccaaaaactaggcatcctgcacctaacagccaaactgtgcatgaaaagaaaaagttcttgaagaaaattaaaagtattactccaatgaacacatgagtggtatgaaagtgaaagagacttatcgctgatatggagaaggtttgagtggtttggatagaagatcaaaccaaccacaacatttccttaagccaaaccctaatcaagagcaaggacctaattcttcttaattctctgaaggctgagagaggttgggaagccacagaaaaaaagtttgaagctagcagagattggttcatgaggtttaaggaaagaagtcttctccataagataaaagtgcaaggaaaagcagcaagtgctgatgtagaagctgcagcaagtcatccataagatcagctaagagaagcaacaaaggtggctacactaaacaaaggtttttactgcagataaaacagccttatattggaagaggatgtcatccaggacttttacagccaggtagcaaaataaatgcctgacttcaatgcttcaaagaacaggatgactcttttgttaggggcttaagctgaagccaaagctcatctaccattctgaaaattctagggcccttaagaactatgctacatctactctgcctgtgctctataaatgggacaaagcctgaatgacatcacatctgttacgacatgaatattttaagctcacacctgagaactactgctttaaaaaaagatctctttcaaaatattattgttcattgacaatttacctggtcacccaagagctctgatggagaactacaagaaaattaaagctgtttgcatgcctgctaatacaacatccattctgcagcccagggatcaatgagtaatttagactttcaaggctgattatctgagaaatacatttcataaggctgtagccaccatgtatagtagttccttcgatagatctgggcaaagtaagttgaaaaccttctagaaaggtttcaccattctagaagcatttgcaattcatgggaggaggttaaaattaagaacatttgtgattcatgggaggaggttaaaatatcaatattaaaagaaatttggaagaagttgattccaatcctcatggatgactttgagggttcaagacttcagtgcaagaagtaactgcagacgtggtggaaatggcaagagaactaagattaaaagatgtgaagagaacttaagatgtggctgaattgctgaaatctcatgacaaaattttaacaaatgagaacttggatgagcaaagaaagtggtttcttgagatggaaactactccaggtgtagatgctgtgaaccttgttgaaatgacaacagagtatttagaaaattgcataaacttagtggataaagcagtggcagggtttgagaggattgtctccgatttgaaggaagctctactgtgggtaaaatgctgtcaaacagcattgcatgctacagaggaatcttgaaagaaatagtcaactgatgtagcaaacttcattgttgtcttattttaagaaattgccacagccacctcacctccagcagcttccaccatgatgagtcagcagccacaacactgaggcaaggccactgaccagcaaaaagatcatgatgttgaagactcaggtgatcgatagcatttttaaacagtaaaataatttttgactaaggtatgtacattgacttttttatacataatggtattgcccacttaatagactacagtatagtatagacctaacttttatatgcactgagaaaccaaaaattctgtgtgatttgccttattgccatatttgttttattgcagaactggccaccagaatcttcccttcccctagaacgcccttcacccaagccacctgcattttcccctcacccatcatacccacccccattgtctggcctgccctccacctcctccaaaagccttcattgctcccccactgctggactgcattctgactccgtctcaatgtgactcaatggcacttccattgggcactgccctaaagagctcatctccacagtggcctgaaaccaaacccacagtatctctgaggtatgcctatgtagcagtcccataagttatcgtgcactttaagcattaccaagtccagaactgtaaatgctacacatttacagaaataccacttgaaggtttaactacttataactgtttcataattagaattacaaattttgaatattaattattttaattggggggaggggccaagatggttgagtagaaacagctctactctgcagcccccactgagacaaacataaacagcgagtgaattctgcatttctaactgaggtatccagattccctcattgggactgactaggcagttggtgtgacccatggagagcaaggaaaagcagagttgggcgacagttcacccaagagctacacagggcaaagagacctccctcctccagccaagggaggcagtgagggattgtgctacccacccggagaactgtgctttacccacagatttttgcaaaccccagaacaggtaatccctttgtgagtccacaccaccagggccttgggtcccaagcacaaagctgtgcagacccatagcaggggctccagctggcagccacttgggcaggtactgagctgtaggagtttctgcgtactctggtggctcgcagtaatccagtgaagcaggagatccatcaactcccatgagaagagggctgaagccagggagccaagcagacccactcccacagaaccccacaagctaagacccactggcatggaatccccactggctagcacagcacttggagtctgcctaagaagaccaagttcctggggggaagggtgaccaccattactgcgggtctagccggtggttttcccccaccagtgctagggagactgggtggtttgcgctgggcagaattccccacagtgcagtacagaggctgtggcagatataccattattgcatatccaaaggaatataaatcattctattacaaagatacatgcacgtgtatgtttattgcagcactgttcccaatagcaaagacatggaatcaacccaatgcccaccaatgatagactggataaataaaatgtggtacatatacaccatggaatactatgcagccataaaaaggaatgagatcaagtcctttgcggggacatggatgaagctggaagccattatcctcagcaaactaacacaggaacagaaaaccaaataccacatgttctcacttacaagtgggagccgaacaatgagaacatatggacactgggagggaaacaacacaccctggcacctgtcgagggagggccggtggtagggagagcatcaggaaaaatagctaatgcatgctgggtttaatacctaagtgatgggttgataggtgcagcaaatcaccatggtacatatttgcctatgtaagaaaactgcatgtcctgcacatgtatcccgaaagttaaaataaaataaatacataagtacataaataaaattttaaaagacaaaaaaaaaaatcttaattgtatgtgggtagttccctttgattgaaagtgagatagaaataattttttaaaacttactattcaaaatttgcaaaactaaataagagtaaaagaaatttacattttgtccctggattgatacaagacaaaaacatagtgtggaaaagctggagttgaggatgaacgagattctgagaataaaaatccctggtacatagccaaaatttcagaacttcagattttcaagggctataaaataggtaacctcaagccaccgtctccaacagataaaaggaaccaggtaatatctatattccagggagaaagaatagaaaattggctatcactgacaaaacttagtgggaaggagggatctagaaggtgggatggtggagggatccccagcttggggggtagggaggggctgtgcttcagtctccccctcccctgcccctctccctccctctccccctcctgctgcacctccccctccctctgcgcctccccctcccactgcccctccccaacaaaggagccctttgtgacatcaaggccccacctctgtgacgcaggcctgggccccagtccctagtccccacggggatgcccagagctcagttgcttgaaagcaacgcgcctattcacatggagaatcttccctttcctttaaaattacttagtgcctcatcgctaaacgcccccagttccacaccatgggtgttggatatcttcctcactttggtgtttgccctggggttcttcttcctattactcccctacttatcttacttccgttgtgatgacccaccctcaccatcgcctgggaagagaaaggtaaggaaccctcagtcccaacccacagagcttgattctctcctttctttttattattagttccacttttccaaatccagtggagagccttctatgatgggaagtctcagaagagaccagaacatcatccttccagggagaggcagggcagccaggggttggtaggggtagatagtgtactgggatttccatcccaagctctcagtccatctgtgggggagcacaggaggcatcaaggcaaaatcaaaccagtggactcagcaccagtaccagtcatgagactggggaggtctctgtccgagaccaggccctgagccctggctcatcagcccctttctggtgcaggtggctcagggcccagcctcccctgtgtggggtgatctggggcctgtgctgggcccctgagggcctcccaccagggcctggtgtctcctctggtctcctgggaagcagaatcctacctgatagctcagcagtgcctgcgggcctgaacttgggtgttcctggagcagaggaacagggactgaaggtgtccgtggtggacctcatattgaaaatccctctgtgtgtgtgtgtgtgtgtgtgtgtgtgtgtgtgtatttttattttatttgtgtgtgttatttttattttattttattttattttattttattttattttattttattttattttttgagatggagtctcgctctgtggtgcaggttgcagtgaaatggagtgatatcggctcactgcaacctctgcttcctgagttcaagcgattctcctgtcttagagtcctgaatagctggggattacaggcgcccaccaccatgcctgcctaatttttgtatttttagtagacacggggtttcaccatggccaggctggtctcaaactcctgacctcaggtgatcaacccaccttggcctcccaaagtgcttggattataggcgtgagccaccacgcccagccccctcttgctgtttttctaagaagaaaagcagtttatcatccatttaaacaagagtgggaggaagcacacagagctccctgagcaagacagagagagccatgcggttcctgagtgcagcatgctgcggctgggctggggcagagagggagagccggtcctagcttcttaccctttcttgtctcccattgtcatcttgtctctccgcgtcatcttgtctccgtacgtcatcgtgtctcccagtgtccagtagggcggaggcggaggcccagaggcaggatgaaaaaccacagtctgagaggtaaggctctgccagagcacactagggttaatttgatctcatctgtcccgaagggaactgactctgaagaagtcagttgaagaagcctgaggtgggggctcctaggaaggaaatcagaaccccgggtccttctcagattccatgcgggaatgaagccatggtgggccagggactgggcgttacccagcagggggcagtgtgtgtgtcctggggagaccaatgcctgcctggatgcggaggggggtgagggggcctcccgctccctgggaacagctgtccaactctgctaaggctgattcctctttgagaccacctcagtcctttctccccacagggcagttgtgaggactgtgggggtggggggtccgtgtgtggaagccctttgtgaatgaaaaagccctgtcctccatgccttgctattaacgtcggggtcatgtggctttggacacagatgggtggggtccagggtctaattccccatggtcctccctaaagaaacagccactcagcctcctgtgagaacccaggcccctccctcactgccctaacccagtctcctgatttccagctggtagagagtgccggagaggcctggaggagacttcggacctgctttcacaactgcagaggtgaggcacttccccttccctgcatccttcctaccagggctgggacgtgaccccagggccacaggcagcctggagctgacctgggatggggagaccaggggtacagaggatgggagtaaaaccctggggcgaggggtagcaggagaattgggcaatcagggtgtggggtggtggaggggctgtggcccgagcacccactctgccctccggccccaccggctcctggctgcagctcgtgcctcctgtctcctgcagcctcctggggccacaccttgacaaaggtgactttggtcagctctccggtccagaccccccaggtgaggtgggcgaaagagcacctgatggagcctcccagtcctctcatgagcctatggaagatgctgctcccattctctccctgttagcttccccggatcctcaagccaagcatcctcaggatctggcctccaccccatcaccaggcccaatgaccacctcagtctcctccctaagtgcctcccagccaccagaaccttcccttcccctagaacacccctcacccgagccacctgcacttttccctcacccaccacacacccctgatcctctggcctgctctctgcctcctccaaaaggcttcactgctcctcccctgcgggactccacactgataactccatctcactgtgactcagtggcacttccactgggcaccgtccctcaaagcttgtctccacatgaggatttggtggcttctgtcccagccatctcaggccttggtggctcaaacagtcatgtttctgcctcctcccggtggcaggagactgccagaacctcgtgcgcctttaactcatcagtccagcaagatcatctttcccgccacccaccagagacctgtcagatggaagctggtagcctgtttttgctcagctctgatggccagaatgtcgtggggatacaagtcacagaaacagccaaggtcaacatttgggaagaaaaagaaaatgttggatcatttacaaatcgaatgaccccagaaaagcacttaaattctttgcggaatttggctaaatcattggatgctgagcaggacaccacaaacccaaaacccttctggaacatgggagagaactcgaaacagctgcccggacctcagaagctctcagatcctaggctctggcaggaaagtttttggaagaattatagccagcttttctggggcctcccctctctgcacagcgagtccctggtggctaacgcctgggtaactgacaggtcttatactttacagtctcctcctttcttgttcaatgaaatgtccaatgtctgcccaattcaaagggagactacaatgtccccactgcttttccaggcccagcccctgtcccatctggggcccgagtgccaaccctttatttcatccacaccccaattccggcccacacctatggctcaggccgaggctcaggcccatcttcaatcttctttcccagtcctatctcctgcttttccatccctgattcagaacactggagtagcttgccctgcatcgcagaataaagtgcaagctctctccctacctgaaactcagcaccctgaatggcctttgttgaggagacaactagaaggtaggttggctttaccctctagggtccaaaaatctcaggacgtctttagtgtctccactcctaaccttccccaggaaagtttgacatccattctgcctgagaactttccagtcagtcctgaactccggagacaactggagcaacacataaaaaagtggatcatccaacactggggcaacctgggaaggatccaagagtctctggatctgatgcagcttcaggacgaatcaccagggacaagtcaggccaagggcaaacccagtccctggcagtcctccatgtccacaggtgaaagcagcaaggaggcacagaaggtgaagttccagctagagagggacccgtgcccacatctggggcaaattctgggtgagaccccacaaaatctatccagggatatgaaaagcttcccacggaaggttctgggggtgacttctgaggagttggaaaggaacttgaggaagcccttgaggagtgactcgggaagtgatttattaagatgcacagagaggactcatatagaaaacatcctgaaagcccacatgggcaggaacttgggccagaccaacgagggcttgatccccgtgcgtgtgcgtcgatcctggcttgctgtcaaccaggctcttcccgtgtccaacacccatgtgaaaaccagcaatctagcagccccgaaaagtgggaaagcctgtgtgaacacagcccaggtgctttccttcctcgagccgtgtactcagcaggggttgggagcccatattgtgaggttttgggccaaacacaggtggggtctacccctcagggtcctcaagcccattcagtgctttaaactggaaaaggtttcatccttgtcccttacacagcttgctggtccctcctcagccacctgtgaatctggggctggctcagaagttgaggtggacatgttccttagaaagccaccaatggcaagtctgagaaagcaggtgctgaccaaagcatctgatcacatgccagagagtcttctggcctcctcacctgcatggaagcagttccagagggcaccgcgaggaatcccatcttggaatgatcatgaacccttgaagcctcctccagctggacaggagggcaggtggccatctaagcccctcacgtacagcctcacaggcagcacccagcagagcaggagcttaggagcccaatcttcaaaggctggagagacaagggaggcagtgccacaatgcagagtccccttggaaacctgtatgctggcaaacctccaagccacaagtgaggatgtgcatggtttcgaggctccagggaccagcaaaagctctctacaccctagagtgtctgtctcccaagatccaagaaagctgtgtcttatggaggaggttgttagtgaatttgagcctggaatggccacaaagtcagagacccagcctcaagtttgtgccgctgttgtgctccttccagatgggcaagcatctgttgtgccccacgcttcagagaatttggtttctcaagtgccccagggccatctccagagcatgcctactgggaacatgcgggcttcccaggagctacatgacctcatggcagccagaaggagcaaactggtgcacgaggagcccagaaaaccaaactgtcaaggctcatgcaagagccaaaggccaatgtttccccctattcacaagagtgagaagtttaggaagcccaacttagaaaaacatgaagaaaggcttgaaggattgaggactcctcaacttaccccagtcaggaaaacagaagacacccatcaggatgaaggcgtccagctactgccatcaaagaaacagcctccttcagtaagcccctttggagaaaacatcaagcaaatttttcagtggattttttcaaagaaaaaaagcaagccagcaccagtcactgctgagagccaaaaaacagtaaaaaacagatcatgtgtgtacagcagcagtgctgaagctcagggtctcatgacggcagttggacaaatgctggacgagaaaatgtcactttgccatgcgcgccatgcctcgaaggtaaatcagcacaaacagaagtttcaagccccagtctgtgggtttccctgcaaccacaggcacctcttctactcagaacacggcagaatactgagctatgcagccagcagtcaacaagccactctcaagagccagggttgtcccaacagagacagacaaatcagaaatcaacagcccttgaaaagtgtgcggtgcaacaatgagcaatggggcctgcgacatccccaaatcttgcaccccaagaaagctgtatccccagtcagtccccctcagcactggccgaagacatccggtgcctctagccaccatcaccactgtccaaggcactgtcttctttgggaaggtatctgatttggtcagtcacaaattcttttttagccttccctggagaaaaacaagtccccaagaaaaaattcactctatgtagagaaaaaatattttctctcatgttagtacatgcagaacatttaatattccacaatatatatggttttttattcataagagggtgatggcttttatttgtgccatgcttggtgtgggcttggtttccagaagcgacaggacatggagggatgttgacagtggtgctgtaagcccaccttcatcctgagttccttcactgaaccttatgtttccgtaataccgtctttacacaaacaacaaaaaattctaaaaacaagatgagaaaaacctatgaaggtcccactctgaaataaggttcaacccatctttccactacttactctacctcaaacttcatgcaactgtagggagaaggtttgcagagatgtcacgggactgaacatctccatgcaggctccaggaagtgccacagccgagtaccttcatgtgtcacaaaatagtggaagtttgggtgggagagtgctgggccctgagtttagaagtgggagaagtcttgaccctgggtatcctggtggagaatagataacgtctgcccctgggaagccccttctctccctgacaaaggctgggatggagatgggctctcttagctcagccaacatgcaaagcagagagtccccatcccactgcctctccctttctcgcactctggagtggcagtggggacagaccttccagctctgtgcatgtgtaggtgggggctagggggtcaggggggcagcctttatggaggttgctgagggccgtgaactcccctgccccagatgaatgaatgaccctgctcctgggtcaccggcctttgtctatctcacctacatgtctctcagcttcagtgaagtagttctgggtgaatggagtagggtatgcctgtgtatgcagaggcttctgatggtgggactctgtagagctacaggggatgcagacagagaattgaaaaggaggcaaagtggcgtgtgtgagggagccatcagtggtgccgtgagccaggagactctgacattccaaccccttagacaggcctagaggggcctagtgtctcatcctggccacaccccagggtctgtctctgctccagctcccagatcacagacccctagaaaaaccacatttacccccaacacagagggccatattagtgagaaggcaaagtgaataaggaagatgaatttcttaacatcttcgataagcttgcacataataatctattgaactttttttttttttgagacagagtttcactgttttgcccaggctggagggaagtagtgcaatcttggctcactgcaaactccggcccctgggttcaagcgattcttctgcctcagcctcccaagtggctgagatgataggcacccaccaccatgcccgactaatttttatatttttagtagagacggagttttgctatgttggccaggctggcctcgaactccttgcctcaggtgatctactggcctcagcctcccaaagagctaggattacaggcatgagccatggcgcctggcctacctattgaattttttaaaggatgtgttgacaataggtggaaaagcaaggactagagaaccccaggcatgagtcgaagtctggtgacctttaatatacacgtagccccaggactgctccctggggaaaggtggcgacttacaagggcccagcagctgagctggggtcacacagcaaatctcccctggctcctgacatccttgcttgtcccagagaccagcaagggaagatgcaggcaggcaggatttgaacatacaagggagctggaagtgacctgtccagaatgggcagggtatgggcaggacaggagccatccctgctgtctccctctgctttcagcacagctttcctcctctctgggccctgtccatatgggaaagcaggaggtctccacaaatcatggacaggaggagccaggtctctagagggagttttctctgccttgtgccacatacaggcgtgcaagaagcccacttccgggggcctcatttcaatggtggagaggccagtgccaggcagtgccactgatctagatgacaatggaaatggccctgcccccaacatgtgggactggccggcaccggggtgcagggggcagtgggcacagtccccagcctgtggcttctcctggggccaggtcctctctggggcccggataactgaagcagcctccaaggtgggcccagcggtgacagcggagccaggatcagcaggaggagctgggacctggagcagagagcagccccggtcctccgggagctcaggagagtgtggcacagagctgggaccctgaccactgaggatgggccatgcctggctgctgctgggttccctcaggaaaccaagacgcgagttctgggatgtggaggagctggacgtggagcccatggctcaggccaggagaagcgccacaggcaacgctgagagaccagcaagaacacaggaagcaacaaccccttagcccttctgcagctcagtctcccatgacatgcagcgaggccagcaatggagagacccacggagacctcccacaggaacctcacagagatatctcgtacagagtgagcacactgggacctctcactgccacggagagagacacactgtagcctccacagagaccccacggagctctcagagtcctcatggtgccccacagagacctagcacagagattcccagagtcctcacccagagaaccccacagaggccacgctgagagacttcactcagtcccacagagacctcccgcaaatgtcagagaccttccatggttctcacagggagatctcacacagagaccccacaaagacctcagagacttcacacagagtcataaaacagggacctcatgcagagactcatgcagctcactgcaacctccggcctccagccccagaaatggcacacggcaccccccactgcctcacagagacctctctcagagtcctcctcacacagagaccttgcctggagacctcccactctccacagagaccttgtatagattcctcacacaggcctcaggttgctccacactcattgcccagaaacctctcacatagaattccctcaaacattccacacagagattctgtagggctttcacagggtcctcacacagggtcctcacacagggacttcatatagtccatggtccctcacacagagacctagcacggagatttcacacagggacttcccacagagaccccacagagacctctggaagatacctcccacacagaccttctgcaaaggcctcatacagaggcctcacaaggggcaatggagccctcttgctgccccatggagtcctcccacagagacctcatgtggcctcacaggcctcgtacagaaactgactcggatttcttagagactttccacacagaactcacgcagaaacctcaaactgaggctccacagagacctcactcagagttctcaccaggagcctggcactgaggcctcccatgcagcgctcacacagcgtcttcaccataggtgagatgcccctcacagatactcctcagagatctggcccagaggcttcacagagacctcacatccatccattctttaggggcctgagcagccacctgttgacacgtccttctcagtggatataaaaccactcagcacagtagcagcacagccgggatatcagttgcactccccaggaaccctgggacacccagatactgtcagcattgcagtgaaggcggttttctgcttggggacatcctcacactttttttttttttttgtaatagcgctgcctctgaaaagaattatggattccacaggcagacctgcaaaattctttcttccacaggtttccattagcttgaattctgacccacaatttagaaaattcatttttttaaattattttttgagatggagtcttgctctgtcgcccaggctggagtccagtgggataatcttggctcactgcaacctccgcctctggagttcaagagattctcctgcttcagcctcctgagtagctgggattataggtgtgcactaccatgctcggctaatttttgtatttttagtagagacagggtttcaccatgttggccagctggactcgaactcctgacctccggtgatccacccgcctcggcctcccaaagtgctgagattataggcatgagccactgtgcccaaccaaaaatttttaagtgaagaaaatgttaccaaccttcaatgaaagaaaatatcttatttgttcagtttgttattatccagccaaattacatcaatgtcatatattttttaaagtttgggggagacaagacttgaatttgagatgcctgacttctgtactttgaaaatatgataaaaacctctagaaaatgaaccccagaaatgaaacaaaccagcaaagaggcatctggactcacactggtctcccaggggactgtgcaactagcacataatttcatacagaacagcttggatcacgtttgcagagttcattttatttttagcaagctaataatcatgcaaagatttttcacaaataggtcaaatctctagcaatattcttattgtatcacttggaaaaattatacttcttaataatattattttattccttaaaatgcagtaatgccctcaaatagtagtatgacacatgtttgtcagacatgacttagtcctaatgttccacaaacatagcttaagcagatgggcaatttaaaaggatttattttttaaacagttctatgaaacacgcattctctaagatgggcagtagggatccattttatattcattacagggctaaaaaaggaatgttttgaaatcttacaaaacaaattaatctatgcttgagatatatacatagcctaataaaatatattgaggaagggacacgttaacatttgagtggaagaaggtatacatttaatcagcatttgtataataaaaatgaattatgaatggcctcactaattatatacgcagcactttccaaagggtgcactctggtaagactacttacttctcattgctcataagcaaactgttgttcttgccttggtaaaatctattttaacaatagctgttaaagcatatcactagattatccaacgggatgacagggtcacagtcttttctctaagagaggcatagctgacatcaaggctcttttagcctatttgtttcaacaagaaatcccctttctatattcatcataattaaaaaattttaacttaatttttccacttccttataatgtcactgcatcgtaaaataatggaatcgacatggatcttcagattatacatatacatatatatatagttttgtttttgtttttgtttttttttttttttttgagacagagtcttgccctgtcacccaggctggagtgcagtggcatgatcttggctcactgcaagctcagcctcctgggttcacaccgttctcctgcctcagcctcctgaatagctgggactacaggcgccagcaaccatgactggctaatttttttgtatttttttttttagtagagagagggtttcactgtgttagcccggatggtctggatctcttgaccacgtgatccaccctcctcggcctcccaaagtgctgggattacaggcatgggccaccgcgcttggcctatagattttttcaacagcgcaacttaaataagtttagttatcagaacaaaatagagtcaattagaaaaaaaaattcatacagaaaaatatacttttcaagttgactgttttaacagagttaaaataagtgattatacttcagtcatttgatttaaatttgctcagagtggccagaaaatctagaaacatagaaaatgtccatactaaatagttgattgctatgacacgttgaatgtgctgttcctcaatagtaattcatagttcagtaatctacgcaaaattgcaatgaacaatgtgcattaaagcaacatttccatcaatcagtgtatattcatctgccatatattgcctcagatgatttgagtgtctaatttcacagaataaatttgagcctttaccccagaagaaataatcaacggggctcaatctattaaaaagatattgacaatatttccaggctctattaacatctataatttatttttaattagattcacctaattcaaagcttgtaaatatttttaccatttatatgtgcccagatgaaatggatatcaataattagataatggagaaaacaacaaacacagatcttctttgttgttaaaatattttacgtcagagcactttgctagaaataaagtaatttttaatctccaggcaaaagactgtctaaatgacattcagaatgtattacaaatttagatttagaatagatttatgtttaaaacaggcctcatactgctttcaacaaatcgggcactacagaacagaatgtggggagggtgacaatgatgtgatgacttcttaacactgagcaaagaagcaaaaaacaagttgtctttctacaatgttgatccctaagagtgatttccctttatagattgcaatataattccagttgcattgttattattttacaaagaactcccacagaaaaaactttctggaggttttcccctatatacacacctacattctctgccatgctcacaccgttggcaaagtatggtgcatccagccacagaccatcaaggggcttgataattgcctcctccatataccttctgaggtcggtcaggtttataaccattcgtgtaacacaattcatccttataactgggcctatggccttgtggcttgtcaccttttccaagcaggtgcttgtcatcttggttgctcagaggtttgctgtggcatcttccctcacctgcggccgggctggcctccaccatgttgcaaccagaagagcccacttccgtggggacagagcttccgtgctctccacagccacgtcacgctgccgctgtgcaaatgatgccaactgtaaatcccagaaaactgcaaaataatgctgcgccaggcacagtcggtgaggatttagaggatgctaacgtctttcctaagaaacgtgggtgacatcggccaggcacggtggctcacgcctgtaatctcagcaccttgggaggtcgaggcgggcagatcacaagatcaggggatcgagaccatcctggctaacacggtgaaaccccctctctactaaaaatacaaaaaaatttgccggacatggtgggggagcctgtggtcccagctactcgggagcctgaggcaggagaatgacgtgaccccaggaggcggagcttgcagtgagccgagatcgcgccactgcactccagcctgggagacagagcgagactgtaagactctgtctcaaaaaaaaagaagaaaaagaaagaaagaaagaaagaaaagtgggtgacatcactctggttctaatcattttcgtgcttcagctgcccccactggatcagtgtttctggtgaaaagcaatcagttttcggagggcctcaccctccttcactgtaatgatgtttgcagttctttctttctcctctatgccgaaaatccggaattaccaccccctgttccccatggttcacaatctcaaccacgtttctccagtgaccacttcaattcacacagccatccctcagttcaactattgcctttgaacatcatgagcaagaccacggctctttgtatttctgccacagtttcacaccagttacagattatatacattcttcacgtcaataagtttattttgtagagtgtggtttctggagtcagatgaactctccacctactaggtctgttacttgggcaagtcatttcttgcctagatttaccaatttgttagagttatattactttactccaaaagattttattctgtgaattacattgcttttcttattttttaaaaattgtaaatctagggatttaggcttggttgtttttttaaatatcagtacttatctaaacaagtatttgaaaatttttcttttttctttacgtatattagaaatctggccaggcacggtggctcatgcctgtaatcccagcactttgggaggccaaggtgggcggatcacctgaggtcagcagtttgagaccagcctggccaacatggcaaaaccccgtctctactaaaaatacaaaaaaattagccgggcgtgatggcaggcacctgtgatcccagcaacttgggaggctgaggcaggagaatcacttgaactgaggaggcagaggttgcagtgagctgagattgtgccactgcactcccgcctgggcaagagtgagaccccatctcaaaaataaaaaaaaaagaaagaaatctgttaacagccttgctatgaagacatttttgtctgtttcttttactttgtgtacttatttaatattaaaacctgtattattgctcagcaaagaggagaattgtttccttggaggaaaaaaaacatccttaagaacttactagtttaaagctgagcatcttagatttgaaggttgccttacctttttaaagattttttttatgagttgatagaaagtcctaaaatcttaggaacagaaacaattgagaattacaagtcaaatcattgaaatggagccatctgacagtttatgtgttctgctgtgccagtagtgagtgggaacagtttctatgtgggaatataatcagggtcctgactacccctaaaggagctctttcttgtttggtgtgaagccaatacaccaaaccaagagtgagtatcaaacagtgtgggcttttttcaatggccatggaattgcagaagtgggagcatagcctgcaaatcaacttctcagagcctgagaactgaggattcttaatgaaggggctggtatacagaggaaagggagaaatattcatagcttttcttgggaagggaggtaggtttttttggaatcaaagagccacctcttttctgcctgtttttggtctcttctggccattgtcatggtgattgtcaactgtcaaggtgccagtgggagtgtcgtttagcatggaaattggatcataatgaagctagaggtttttcagaggtcaagctgccattgcggattttgccagcttcagccagtttagtcctaagaaggaacttctgaccccagacatcctgttttctaaaactaagcagttaaagctgaatgggaatttagctctgtcacataggcattggttgggcaacaaaagcagggtagggctccagctaagccacgtaggcactacgatgggcaacagaaaggttggtttctgggcaattcagagaaaccaaggacagctacccccagaactcagagtagccaactgggctgctcacaggagatgccttaactgaaaggtgatcagactccacaggagacccagagaagatgtggagggagctcagaggttgtcctggaggagacgtggagacagctcagaggctgtcccggagaagacgtggaaagagctcagaggctgtcccagagaagacgtggagagctcagaggatgtcccaaacaagagagagctcagaggctgtcccagagaagacgtggagagagttcagaggctgtcccggagaagacgtggaaagagctcagaaactcagagactgtcccggagaagacatggaaacagctcagacgctgtctgcaagaagacgtgcagagagttcagaggctgtcccggagaagacatggagagagctcaaaggctgtccacaagaagatgtggagagagttcagaggctgtcgttactgctgcacttggctgtttttctttggataattattgccatcaattttagtaattcaggtgttaaatcacagtcaagcacctatttacctagtggtgagttcctttatgttgtgagttcaatgtcatttgtggggactgtggtccagggaggtgttgggaggatgaagttttttctgagtgactttgcaaacataaaaagtcacctaataaagatgctagaaaagcaaatatcctaacttcctagtcagaaaaatgtccaacaccatgtttatttaggggcaaaattatgtattcagaagaatttttcacaaaaaaacagtggtgggagaaaattacacatctgggcccaacaagtaagactttcccttcacaattgtgctgtgggatcccaggcctcggggggctactgccgtcaccatccccaggctgtgggcccctttgtcagctgctcttctgaaggcaggtctcctgtccatgccttcccctttgttgtccggatggagattggagacgcagcatcatatacagctgacaggtgttaaccttattagctaattctgtttcacgggacacgatttatacactccatggaaatgcttctcactgcctttttttaccacttcaaggtagaagtaggtaatagtgctaaagtcatcttactagaataacaaagtccatggtttgttgtccctaaaaatatttgtattagtttactagggctgccataacaaaataccacagactgagtggcttaagtaacataaatttctttttttctttctttctttctttgtttatttattattattatactttaagttttagggtacatgtgcacaatgtgcaggttagttacatatgtatacctgtgccatgctggtgtgctgcacccactaactcgtcatctagcattaggtatatctcccaatgctatccctccccccttcccccaccccacaacagtccccagagtgtgatgttccccttcctatgtccatgtgttctcactgttcgattcccacctatgagtgagaatatgtggtgtttggttttttgttcttgcgatagtttactgagaatgatgatttccaatttcatccatgtccctacaaaggacatgaactcatcatttttaagaaaatgtggcacatatacaccatggaatactatgcagccataaaaaatttcttttctcacagttttggaggctggaagtccaagatcaaggaatcagcacatttggtctcttctgaggcctctctccttcccttgccaatggccaccttcttactgtgtcctcacatgattgtcctgtggtctgtgtgtggtctctgtccacatctccttgtcttacaaggaaatcagtcttactgattagggcccacccatataacctaattttacctcaattacctctttataggtcctctttccaaatacagccccattctgaggtactagaggtgaggacttcaacataaatttgaggcaacacaattctgtccatgacaattgtccaccttagttttatggtgaaccaaggctgtgaaaaagacttgacttggggccgggcatggtggctcacgcctgtaatccctacactttaggaggccaaggtgggtgcataacccaaggtcaggagttcaagaccagcctggccaacatgatgaaaccccatctctactaaaaatacaaaaagaatgagctgggcttggtggcgggtgcctgtaatcccagctactcaggtggctgagacgggagaattgcttgaacccgggaagcgaaggttgcagtgagccgagactgcaccactgcactcaagcctggacaacaagagcgaaattctgtctaaaaaaaaaaaaaaaaaaaaaaagacttgactgaaggcagtgacctaagagtgaagcgataacagctggcaactgttccgcaagaaggtgcaaagcccctgcaggcctgggaaggtgcagagcctgcacctcagatttgactcctctcatagaatcatggaatttaagtgaacctcttccagtattagggaatcttgaatggaaactctaatatcttaatccccagtgtaacaaacttttactacattgttctcatgatgacaaatgtctcatcagaaaatggcttaaaagtataattattatgaaagcagactggcttatttaaaacaaacataatctgaaaactgtaatccaaaaagtagacatccatatatatatatatatatatatatatatatatatatatatatatattcattcattctctttgctttgaaactttcactgaatgacctttgtccgttttatcagtcaccatattttagtggtgctgtgcagtgacttttgtagagtaatatctctcaaagtgtgcagtgatcaatattgtgttgtcaaaagattctgtagtcaaagaagtttggaaaactttaattttttgattaagcaaagcaagaagtctgagtttcatttattggtttactatgaaaagtgttagaggctttatgatgtgcaagaaggacatgtgtcataatatttctcaaacctatttgacttccaatacttgcttttttgttttttcttcttttgtggagaaatttcaaaaactttggaaaatactttttaagtgagattcaggagtttgataagcaagatgacaaatactaaaaatatacactccaaatatagacacaatgaatactaaataaactcactgtttttagtcaacattattcaaggatatccaaagtttttcatggcataaaatgctctttttcttttcagtaatatgatacatgtgatattcctggaaacttaaaaaaaaatcatcatttatgtgctctcttgtcagtttcatgctgtatttttgatgtagaagaaagaatttggtatcttctcaggaatacattgtcacataaaaatatgtaaactccttcagataaattctcacctgcagaatgagtcaaacagcagggggagaagctgaatctagtgttcgcagtgagtgacctgtcttcctcaacactgtcatctcatctattgtcttggatgctcaagaaacggaactatataaatgtggcttctggccttcatatattacagtgccaaagcttcaaagaaccagtttttatttaatacttactttgtttctttgcattttttttcaaaaatacaatatgttgttattaactatagtgaccatgttgtgcagtagatctcttcttgaatatttcccctctcctaaatgaaattttgaatcctttgataaacatccccactccccaccccaagtccagcccctggtaaccaccagtctactctctacttctatgagtttagctttttcagattcgacataaaagtgaaatcatatggtctttctgtgcctggcttgtttcatttaacataatgtcctccaggttcatccatgttgtcacaaataacaagatttcattattttttatggctgaatagtatttcattgtgtatatatactactttttaaaattcatccatccattgatggacacttacattgtttccacatcttgggctaatatataaataagatttaatgtatatggtgttgcagatatctcttcgacatacggatttcatttcctttggatatatacccagtagtgggattgctggttcatatggtagttcatttttaatttttgaaggaacctccatgctattttccatgatgcctttccttcaaatcttctccaacacttgttatattttgtcattttataataaccatcctaacacgtatggggtgatatctcaaagtgtttttaatttgcctttctctaatgattagtaatattgagcattttttatatgcctgttggcctgtatgtcttcttttgaaaaatgtctatttggatcatttgtccatttcttattgagttatttttggttgtctcttcactctgctagcacctattttgtataagacaataatgctcttacattttcaaaatatacagaagataaaaaacatatagtaagtatgatacttgaattgtagtgagacgtttaaaattttccaggaaacaattactgtgttttatggttataaggaagaaacatgtacatcattttggggaagaaaaagagaaattatggagtgataagtttaaattgagaaaatatcaacaaatacaatatacgagagaggctctaggcatttcatttacaaaaatattgtccagtttttgtatgtgtgatgtgtgcttgttccctctttccatatctatctctgtctgtctttctgctatggtttgaatgtatcctccaaaagttcatagattggaaacttaatccctcttctctcatgaatagatttatgtcagtcctgccctcatgaatggattaatgtcactagcatagtagtgggttccttatcataagcccttttgctcttgctctctcactatgtgatgccccctgccatgttgttaggcagcaagaaggccttctccagaggccagcatcatgctcttggcattcctaggcctcagagctaaatacatttattttctttataaatcactcagtctgtggtattctgttatagcaacaaaaatattaagacactcttcctatttcccctactctccttcctccagcctctttcttacacacaaaatgttactgaaataccaggagttcaatctaggttctgttacttgcacacagaaagccaatcacttagacaatgaatattgccaaggaagaaggctttaattgcatgctacagctaaggatatgggatatcagtctcaattccatctcctcaaccagccgaaattaggggattatatagcaaggaagaaatgtaactatgagcaggaaaacaggaactagggagggctaaggaagcaatcatgacaaataaggaatctggcatctggcatctcattgtctcgacacagtggtctgatgaatttcacttctttgatactttttgagagagctgagagtccatttcctgaggaagaaactcagagaaaacaaatgtaagtttcaagcttcaagaccagaaggatttgtttctatgtttatatttttaaaatctgtctgtggatctattgggtgcatttcaaaaacacatacagaggaaatcccaggcgctgtgctagaattgggaatacaatggtgagttcaaagaggaataattttcctattctcatgaagctaatagtataggatagagaaagcaaacactaatcaaagaaccacacaagcataagattgcaactacaactaaaaaccataaccattcagttaagctaaggaggccaccattgtcacccttctcttaacctttaataatgtattttacaggtaaaatccttaagtaagtcatatttggttgggaagatcaaagaaatcacccagtctcccacatccgaaattgtgcagtctggactgtcaggaacaaaagtgaaagagagacgtcatcaaggccgggcgcggtggctcatgcctgtaatcccagcactttggaaggccaaggagggcggatcatgaggtcaggagttcaagaccagcctggccaatatggtgaaaccctgtctctactaaaaatacaaaaattagccaggcgtggtggcaggcgcctgtaatcccagctacttgggaggctgaggcagaagaatcacttgaacctgagaggcagaggttgcaataagccaagattgtgccattgcactccagcctgggagacaaagcgagactccatctcaaaaaaaaaaaaaaaaaaagaatgactaaaattaagaagattgatgattccaaatattagtaaagatgtagaacaactagaactcccacatattgctgatgaaaatgaagaataatacattactttggaaaatactttggtactgatttaccatatgaccccaaaatctcacttgtagaaatttatacaggaaaaatgaaaacatatgctcacagaaagcttgtatacacatgcttatggcaataaatttatttatagttgcctaccaacaagtgatgaacaaatatattttagtatcttgatactactttctagctagaaaaggaatactactaagcaaaaatagaggatgaagtagtaatatacataacatagatgaatttaaaaacaccatgctgattgaaagaaaacaattatcaaatacacagtgtaatattctattcacagaaagtttgaaaacaaaaaactatagtctctgaaagaaaaccattggttgcaggaaggtggggattcattggccacaaaagggactgaggaaactttttatgggtaatggaaatattttatatcttgattgtggcaccaattatacaactgtatgtacacatctgtcaaaattctaattgtattatacacaacatgagtgactttaactgtctataaattatatctcaataaaattggtcttaaaagatatatatatatacacacacataatttaatatgtattttatatatatatctctctctctctcgacaatggagtgaaatgtactcttttttttttttttgagacggagtctcgctctgttgcccaggctggagtgcagtggcgtgatctcagctcactgcaagctcccaggttcacgccattctcctgcctcagcctcctgagtagctgggactacaggcgcccaccatcacgcccagctaattttgtttttgtatttttagtagagatggggtttcaccatgttagccaggatggtcttgatctcctgacctcgtgatcgcctgcctcagcttcccaaagtgctgggattacaggtgtgagccaccactcccggcctgtgaagtgtattcttatggtttaattgtcacttagcaaacatccagaatgctaaatatccatattatttctcttgttttgcctttctctcactttttctacaagcaccattttgaagaaagcctcatcaactttattaattatatttgtgatcatttgaagacacagaaaattttcttctgcaaaatataaagtcttctttcatctgctctcgtgatccttttattcttctgccaagtgatgtacattaattgatcaactgagttatgcatgcatttactttttcacagatctttgttatgcctctactagttctatgctagggatatggtatgacattgaacaggatcaatatggtccctgctttcacagagcccacacctaatgtgtggatagtcagaacacagttacacaaacacaagtgggaaataattataacatctgatagatctgaagtcagtagaaaaggtattgaaatggagaaatagaaaggggcctcgctttgataatgaaatcagagacagtttccctgcaacttccttggagggcaaaagccatgtcctttccttctcctaccccaccactgaccccaataaaataccgagcacagaattttcactcaataaattaccttaaaatggatttcaaaatatttataaagcacatttgtgtccattaaagtatgaaaggacatgtatttggagcataaaacccagcacatgatggaaacatcacataaatgaggatcaagaatctaattatgtaatgggaaaatttaaaagaaatgtcaagctggatagagtgtattctaagaaaatgaatacatgtataatagctaaatatttggcatttgagtttgggatgaaaaaatagatgtaaaagaaacagtttccttaattaagaatttaattttgtggggccgggtgcggtggctcacacctgtaatcccagcactttgggaggccaaggcgggcacatcacgaagtcaggagattgagaccatcctggctaacatggcgaaaccccgtctctactaaaaaatactaaaaattagccaggcgtggtggtgggcacctgtagtcccagctacttgggaggctgaggcaggagaatggtgtgaacctgggaggcagagcttgcagtgagccgagatcacaccactacactccagtctgggtgacagagcaagactccgtctcaaaaaaaaaaaaaaaaaattaattttgtcctttggaaggagagaaagaaaaggcagttcacctagaccatcacttgccttttttagttgcagcaaatgccagtttttaaccggatatgtttgcaatgtgtgagttcttctccaagtgctagctaggatgagcttccatacaccgcacccccagctgtggtaatgctttactcatagcctgtctctcatccatctgcctgaattcctgcagaacacagttggaccagcagctcatatttaatcctctcatatgatattaacaccactggtctccatttttgatttacatcttaaagcctccaggctgtaattgttttaccactgtatttcattatttaacatccactacttttatggaaaaaaatgtgtttactcctgtatctcatcttaatgtttcactaactgctaaactcacattttttgttcatttgcattgtttcgagaatctagattgtatttgtgtttggaaacagtcacagccacttccagaggtcatttcccatagaccccaaacttctcttctcccagccttggaggtgctgggttctagaaggaggaggcagtgagtccagaagcccagccatatcaggatgacatctaccatgcatcagtcctcgtgtgtcttcagcgcctctttcacatgtctgtgtccttagagcttgctggaaccatctttgcttgtctctgtgtattctgagtctgtgactatttggctctaggagtcttctcaacaaagtacaatttctgttgtctttttccaaaaaactttatgaataaaatgaaaatatgagtaatataaaatcaaaatatattttgatttctcatttcaaaattatctacctctgtagtttaatagaactcaattattggccccagaagataatttttttccctaaagtattttctaaataataaccagtagttgacctacgtcctttatatatatcacatagaagatctccacagtacattcttcaaattcagctcagataatccatggaatgctcaagttccctgtaacaaattgagctcctatatctctgtggacttataattgactaataaaagtaagacttgtttgctaatgataaagataatttgtaaaaaataaatcattttagtttgaccatgagacgcacacatccattatcattaaatgtgaaaatctagaatatatccagttaatggtcaggtatcaactttatgtcccacacttgccatgtagaagctaagcttttaaaatgtagaattattttctacttttctgttatatgcatatattataaatgacaagtattttaaacactggatttttttaaaaattgctttattttcttctgttttgacaaaagttggctttcaagtttaattaagttaaaaaaaaacgaacaacaaaagtgtattccaatgggagacagataaagcatctttcttatctaaaatacaggaccaggcgcagtggctcatgcctgaaatcccagtactttgggaggccgaggcaggtgaatcacctgaggtcaggagttcgagaccagcctgaccaacatgtctctactaaaaatacaaaattagccggatgtgttggtccatgcctataatcccagctactcaggaagctgaggcaggagaatcacttgaacccaggaggcggaggttgcagtgagccaagatcataccattgcactccagcctgggcaacaagactgaaactctgtcttaaaataataataaaataaaatatatatttatatatggtatatgaatttgatacattttgctttatttcaggactaatgtaatgctacagaaaaggaatgactctaaactcacttaatttctcctgactataaatagcccttgaccactttcaactttcccactgataactctataacatagggcaagttacttgacctcactgagcctattttgccatctataaatcagctaataggacctaacttataggtttgctgagaggtataagtaagacaatagagtctagcatatggtggggctcaacaaatattagtacattacttacactttttttttcaccctgctatgcctttcagtttatttctactaaactctaagttattaaaatacaggctgaagtattattaatttccctctgtgttctccccagttcctatcacagtgccagggacacacaggccccataatccttcatggtcaattgaactgacagtgaactatgtcttcgtccatttgggatgctacaacaaaataccatagaccgggtgacttataaaccacagaaatgtgtttcttatcgttctggaggctgggaagtccaagatcacggcattggcagattcagtgtctggtgaaggcctgctttgtggttcatagatgggtgctttcttgctgtgtcctcatgtggtgataggggcaagccagtgctcctagtctctttgataagagcactaatcccatttccgagggcccatcatgactgaatcacttctcagcaatcctcccttctaatctcatcactttgggggctaggatttcaacatatgaatttgtgtggggggcacaaacattgaatccattgcaatgaacatcaaaggatggtacagtggttagtgtttgtgtatcatggcctacctaataattttatgtctttgttgctgaaaataaaacaaataaaagctttcatttacatgcttttttagcacaccttttctggaaaaaattctctactttagtgctggtttgtgtggctcataatatgtctatggccattaaaatccaatagaactccagagcgaggaagcacattgctgtctttctctatggtgttttccaggcagggtcagattgccaggatatcatcagacattttttggtagacagtgaggggagggggtggagagggtgcagtttattatacgtaaattatacctcaataaagctggtacttcttttaaaatttgccataattctttatattataaagatataaagaaatttttgcactgtctctcaagtttgtccagaggataaaatcagaggcatataacaatataaaatagtattcaaagatcaaatatttatccaaactttaatactagagaaagatgggcaggtataagcatgagcaatgggaaaatgagaaagagcaggagaaggaaatgttactgaagcaaagtcagagattgcctgcttaaaaaagttttaaaagctaatttacggagatggcttctttccttaaacctcacgaaccaacctctactaccttccaacttttcttcttcagcttcctcacctctctcagccttcatagaactgaagagagttagggccttcctctggattaggctttggtttaagggaatgttgtggctggtttgattttctgtccagagcactcaaactttctccatatcagcaataaggccgtttcactttctcatcacttgtgtgtttactggagtagcacttttaatttcctccaggaacattctctttgcatgcacagcttggccaactgtttggtgaaagaggcctagctccccatctatcttggtttccaggatgccttcctcactcagctcaatcatttctagcttttgacttaaagtgagaaatacgtgattcgtcctttcatttgaacacttagaggcgattgtaggattattaattggcctaatttcaatactgttctgtttcagggaatacagaggcctgaagagaggaaaaaagagatgggggatggtcggtggagcagtcagaatacacacatttactggcaagtttgtcatcttatgttggcacagttgtggcaccccaaaacaattacaatagtaacatcaaagattactgatcacagatcacataacagacataataatacaaatttaaaatattgcaagagttaccagatgtgatacagtgacacaaagtgagcacatgctattggagaaaatggtgctgatagacttgctcaatgcagggttgccacatgccttcaatttataaaaaatgcagtatctgagaagtgcagtaaagcaaagcacaataaaatcaggtatgaggctgggcatggtggctcatgcctgtaatcccaacactttgggaggctgaggcgggcagatcacctcaggtcagaagttcaaccagcctgaccaacatgaagaaacccagtctctactaaaaatacaaaattagctgggtgtggtgatgcatgcctgtaatcccagctactcgggaggctgaggcaggaaaatcgcttgaacccaggagggggaggttgcggtgagcccagatcttgccattgcactccagcctgggctacaagagcaaaactccatctcaaaaaaaaaaaaaaagaaactagaaaagaaaataaaaccaacagtaagcagaagaaaggaagtaaaaagcatcagtgtagaaatcaatgcaatagaacacaggaaaaatcatttacaggaaataaatgaaaccaaactctgtctctttgagaaggtccatagtattgataaacttctattcaggcttatcaggaaaaaaagagagaatacaaaaacaacctatcaggaataagagaagtaacataacaacagattcaacagatgctaaagagataataaatggtaattatgaacaacattgtgccaacagatttgacaacttagatgaagtggacaaatgtctccaaagacacaattatctagtcttactcaaaaacaaacagacagaatagcccggtatctattaaagaaattgaagctgtaatttaaaacctttccacaaagactccaatgctaggtctaaatggcttcagtgaagaattctaccaaacatttaagaaaaacatgataccaattctgctagttcttaccaattattctaattaaagagaaaattgaaaaaggaaggaatacttccgaataacctcttgcacttttctcagacttgtaagtgtgacactgggatgaccagttcatggggagaattttatattctttacaggtgaattggctacaaccacaggcaatttcaatttctttccaaatttcttcaggggaatatctgaggaaaaataaagtgcttttgaaatataaacactttctaggaatacaggaatgttgcttatatatgattttaccaatggtctcatgaaaattgtgtggaggactgtggctataaacacaatggtttgaattttatgtaaattcatagctttttattgttatttttaaatacagaaaagttctgaagatagtaattttatttgccagttttttggaaactttatatctgaggaagatctgctggaagatgtcatttggggtaatgcaaaatatttctggaagacacaagtaaaatgggccctcattgaccaagtagtttgtatagatgtagtgattaaactattaagtagaggggaggttgcaaaaatatttgacaaaatgaaatgtgtgcctgcagtgcaaaaccactgatcctgctcacaaacaggcatagtgagaaagatttctatatgcctggtagaacaacctctgtgggccatcttaagcactggtgattaacacttttatgcattctattacatctgaatttcaccacttaacatgatacttaagctgaattaaaatgccttaatactcttgccttaatattcttccaaggtttagcacctggtccttttaataaaaaaaaaaaaaaggttatggttacctttttttgaaaaggtactcaaatatgtcaactttattgtttctagatatacacccctttgtactgaaaattgtaaaaatagcatgaagtttcctcttattgcaatccaaatttttgaaagccagaaaatctaattattatgctctagacaacttacctaatgcattgtttatccacaagtaactttgcttcaatttcttgatgttgggtttcatctcactgactttgggcttctaaatgggaatatttacgtcctcttcgcttctttgggtcagatcaaacagtagagctaaagttattcaaatacattcaaactacacagaccccttataaattactagtatcatggtaggaaggaaaatatataagaagaaaaatacatcctggaactcattatcaaaattattggtgtatagtctatactagcatagagtagctttctcaacctgctatgtaaaattgccagcaagaaaaaaaagtgcaagaataaggtctatgactgaagtggctcggtgtcatgattccctactctagcattctcagaaggatcccatccgttagacgtgcagaaactgcagcccatccaaatgtgatctgtttaatcaataatcaacagttcatattgaagacagtatttttgctatatgtgcttgtcataatgaaggacggtgtacaaagaacaagttgaaccagatgaacactttaattttgatgccaaaatcaatcactttttgtcataacaccaggcatagataatggttgatccagtgcacactgtctgtattaccccataatttcctgcagcagacatgttgtaatttgacatactccttgatcattaacacattgcagtagtcagatatacttgtcaagattaagctaaatgtcagtagaagactcagtgaaggcttgaaaatcttgcagcttgctctcagagacactgccaactgaaatgataaatgtcattgggctgtggtactattctcatcgacgtatcaataaataaagggatgctggcgaaaaaatgttcttccagatacctgcccactctgaacctagagttcttttcatcactgtgaaagacagctccctacacaccgcagccatttcctgggaggactctgagctgtgattttaataacagaatgcactcatctgccatttttcttccagaattgcttgtgaatatcctgcatgctatccaagtctcttcacccttgtagtctttgtataaatgggttcattttgttccttttaatttttttgagacagagtctcactctgtggcccaggctggagtgcattggcgctatctgggctcactgcaacctccgcctcccaggttcaagctcttctcctgcctcagcttcctgagtagctgggattacaggcgcgcaccaacacgcctggctaatttttatattttcagtagagacggggttttgccgtgttggccaggctggtcttgagctcctggcctcaagcgatccactcgccttggcctcccaaagtgctgggattacaggcttgagccactgcgcccggcccctttgttcttatttgttgttattgcagtgggattctaggaggtgctgggagtggagaagttaatcaacatatttagctagcttgaatagacatcccagtattgatagagttgcaatcttaaaaaaagaaagaaagaaagggaaaaaaaagcccaacagtcatgggatgaaaaagtatttgggcgaggatgaaagagtcaaactctcactgtgcacgtgaaatcacaagtatgggcctggcgcagtggttcacgcctgtaatcccagcactttgggaggcgggtggatcgtggggtcaggagatcaagaccaccttggctaacacggtgaaaccccgtctctactaaaaaaaaaaaatacaaaaaattagccgggcatggtgacgggcgactgtagtcccagctactcgggagactgtggcaggagaatggcgtgaacctgggaggcggagcttgcagtgagctgagatggcgccactgcactccagcctgggcaacaaggcaagactccatttcagaaaaaaaaaaaaaagaaagaaagaaaaagaaatcacaagtacgtacacacgcaactgtcctggtactaacacaacattttggtttccttataatattgaaattttattgaatattgaaatacattttattgaagttgagagttgtatcttcttttaccatgaccgccaacatgtatgtgcaataaaagctataagaatatttgcatttgacccctaaaataaggaacttggatttaataatttggcagttgctttgtttcatttaaatttgaatatttttctgttttattttaatagattgttcctattgcattattcaaaggtgttaaaaaaactctatgtggttgattagagaacatttattatgtatatttatttgtgaatatttataataatgagtgtttattaaatatgtacatattatacattataccaggtacatattgtatatattatacattatataaggtagggaatatacgttgcccatgtggagtttataatatagctggaaaaataatatcaacatatatactgtatgattccagctacttttttttgtttctttttgagatgcagtcttgctctgtcacacaggctggagtgcagtggtgtgatcttggctcactgcaacctccgcctcccaggttcaagcaattctcctgcctcagcctcctcagtagctgggattacaggcacgtgccaccaggcccagctaatttttgtattttcagtagagatgaggtttcactgtgttgttcaggctggtcttgaactcctgacctcgtgatcctctcacctttgcctcccaaagtgctgggattacaggtgtgagccaccacgcccggccttttgcccacttttaagttggattatttgttttcttattgtagagtttcaagtattctctgtatattttgaatactagccctttatcagatatgttctccctccctgtgacttgttttctaattcttttaacagtgtcacccatgcagtagaagtttttttatttttttaattataataaagtcccacttagcaagtttttcttctataggtcacactatagggttgtatttaaaaactcatagtcaaacccaaggtcacctgtattttctcctgctatcttttagaagttttatagttttgcctttaaatttaagtctatgatccattttgagttaatttttgtgagaagtgtaaggtcagtatctagattcatttttttacatgtggttgtccagtagttttaacaccatttgttaagaagcatatctttttcccattgaattacctttgcttatttgtcaaagatctattgactatatttgtgagggtctctatctgtactctgtgttctattccattgatctatttgtctattctttaccaataccacactctcttgattactgtaagtttacagtaagtcttgaagtcagtaagcattagttctctaattttgttcttctttaatattatgttggcttttctgcatctcgtgactttctatagatttggagtcagctagtcaatatctacaaagtagcttgcttggattttgataagtactgcattgatcccaatactgatctgtagatcaagttgaaagaactgatatcttaacaatattgaattttcttattcattaacatgcagtaagtcgattttttagatcttctgtggtttcgttcatcagattttcatagttttcctcagatagatactacacatattttgttagacttatacctaagtatttcatttttggtgctaatgtaaatggcactgtgtttttaattttaaatttcaactgttcattgatggcatatagaaaaagaaatgacttctgtaaattaactttgtatccttcatccttgctgtaatcacttataaaagattatatacatagaattcattctaggagttttttgtttattctttgtgattttctacataggcactcatggcatatatgaacaaagacagttttatcacttcctttcttctttttttttttttttgagacagagtctcgctctgtcacccaggctgcagtgcagtggctcgatctcggctcactgcaagctctgcctcccagattcacgccattctcctgcctcagtctcccgagtagctgggactacaggcacccgccaccacgcccggctaattttttgtatttttagtagagacggggtttcgccatgttagccaggatggtctcgatctcctggtctcgtgatccgcctccctcgatatcccaaagtgctgggattacaggcttgagccactgctccccgctatcacttcctttcttatctgtataccttttatttcttttttctgtcttattgcattagttaggactttccacacaaagttaaataagagtgataagaggagacatccttgttttgttcctgttcttagtgggaaagtatctcacttttcaggcttgagtatcatgttaagtggaggggttttttagatttaaaaaatcaatttgaagaagtttctctctattgctagtttgctgaaagtttttgttttgtctgtttgtttgtttgttttgttttttgaggcagagtctcacactgtcccccaggctggagtgcagtggtgtgatctcggctcactgcaacctccgcttcctgggttcaagtgattctcctgtctcagcttcttgagtagctgggatataggtgcgcgctatcatgcccggctaattttttttttttttttttttttttgtatttttagtagagatgaggtttcactgtgttagccaggatggtctcgatttcctaacctcgtgatctgcctgccttggcctcccaaagtgctgggattacaggcatgagccaccacacccagcctgctgaaagtttttatcatgaatgattgttagatattgtcaaattctttttatgcatctattgataagattacatgatttttcttctttaacccattggtataatggactgatctttgactgttgaactaggcttgcattccggagtacatcccactttgttatggtatataatactttccttgtttcttttttaaactattgtatttattgtttttaacactttttcacaacttcaatgacaatcaaataagccacctcctgtgttgtgtttctctgtgctgcttgaagctgcctgtgcttacttttggttctacatagcttctccccttagaatgatatacatagtacagcattcaacatatgctaactcttagtgttgttattatctgaagaccctcaaggactgctcatggtgctgatgtggttggaggggacatgacttgaaccatgtcttgtaactttgcatgaattatttacacatgcttgagacaaggttagttttctgcatcaaagaatgagcagggagatgataaagaggtggctagctccatcctgttccagctatggtcattgctgacgtgcactttgcatacacacgctcatccaagttgcatactgcactcaatcagactcaggtgtgaaagaaaggtaggaaagagggacatgggcccactttcagctctggtttattcagctgttaccactgctctgtatgaggactgaaatgaaatcctcagctaatactgaactggaaggagcagcctgtgtgtggtgaagagataaaacctaaaacaatcttaacagaaacaaagcacttttccaaactaagaagagggcgataaatgtagtttgacactttagtttaaaaatacacaaatttaggccgggcgtggtggctcacacctgtaatctcagcactttgggaggccaaggtgggaagatcacaaggtcagcagttcgagaccagcctgcctggccaatatggtgaaactctgtctctactaaaaatacaaaaattagctgggcgtggtggtgtgcacctgtgctcccagctactcgggaggctgagggagaagatttgcttgaacccaggaggcggggctgcagtgagccgaatcatgccactgcactccagcctgggtgacagagtgagactccgtctcaaaaaacaaacaaacaaacaaaaaaacacaaatattagaataacgcctgtgaaacaaaagtgacctgagtttatgtccctgtggccttgacaaaagcctgtggtataatgaggtcacctcatatcttagtgagtttgaagggagtgaggtctctcctgcccccagcttcagaccacactgaagagcttgagtccagttccagccattggatattcagtaagatgtcaataaatcagagtttgtcaagagaaggagggtgaagggccttctaccctgacatgccaggtctcagacagagaggaaggcattagttgcaggagagagaaaactcaggcatgagcaggatggtcaactttaaattctacagctccctcccatggaggagacattagactcacactaagaagataggtctgtaattggtggatggggctgcaggaagctgtaccacagacaaaaagaagaactcaggaatgaggattctcaaaaatgaatgtgttttctctcaaagaatgtatgacagtgtattcatacagtgattctctgttatctatagaagtctaaattccataagaagttcagaaggtcctttgttcctcacttcctgcctgtaagccagtttcatctcccggacacactctgccaccctgtgtgccctgagtcatagcccctctgcactaactatgcttctcccaaaaacagcatactcctttcaccttcctgcctctgcccacgacttcctcttggtctggaatgcccccaacagttcagctcttaaagctcatataccctcaggccatagttgaaaatatgtatatccttgtttattctcaacagttccaataaaaatccacctcccctttgaagtcttcacgactgctatactttaacctccaaagcaaagttagataccccatgatctgtgctcccatgacacccatccacttcgattatggcatgctccacattctaattatttgcttactgtctcctctagttgactttgagcagacaccttgtcttattcatgtctgcatctgaagagttttcacacagggctcacaccacaatgggtgaatgagcactcagagaggaatctgtacccacgtgaaggcatggacccttcagcactaagcttctgtgatctcataacatcttgccttaatattcttccaaggtttagcacctgatccttttaaacacatttgttaataaacaataaataggctatggttaacttttaaataactagttaatctttattatgaaataagaattttggaagaggcgaagtgatctatatacatgggacggaggaaagtgaatatcaatggcctatgacgcatcattaagtttcttttctatttcatagaactttctactcacattactgtcttattcagtgttcttttgtttggtgttgaaccagcgcaaaatctctgaggttaaaatggaattattctaaaggctggaagcctggtagcttcaagagctagaaccaaagtctggaaagagctccaggaacatctccagctaccctaagtaaatctctcccaggcactctgatcgcttttcacaacttctctctccacatcacttcagcttttctttccacagatcgactatgtctgcttttctaagctgctggttaaatatggaagcaccaacgatcccaaacttaaatattctaagttgaaatgacccatagggaaagaccagtatctctcaatcccaattcccacattttaaagagaaaatgtggttgggtcagttgttctacctttaaataaatagggtcaggtatgggacatgattccgtaacacaaacatggcaggcagggctcaccattgtggggtcagtcctcagataaatttttttttttttttttgagacggcatctcactctgtcacccaggctggagtgcagtggtgcaatctcagcccactgcaacctctgcctcctggattcaagcgagtctcctgtctcagcctcctgagtagctgggattacagatttgcgccaccatgcctggctaatttttgtatttttagtagagagggaagttctaccatgttggccaggctggtcttgaactcctgacctcaggtgatccacccacctcggccacccaaagtgctgggattacaggtgtaagccaccgctcctggccaataactttatttatttatttatttattattttatttatttatgtttttgagatggagtctggctctgtcgcccaggctggagtgcagtggtgtgatctcggctcactgaaagctccgccattctcctgcctcagcctcctgagtagctgggactacagacgcccgccaccacgtctggccaatttttgtatttcttaagtagagacggggtttcaccgcattagccaggatggtctcgatcttctgaccttgtgatccgcccgcctcggcctcccaaagtgctggggttacaggcgtgagccaccgtgcctggcccagaactttattataggtgggacacacataccaaaagaatctgtgcaccacaatgatctaattcaattttgctttttgagagggtttacagaaagattaaactgactgattaacactgagcgctcttttccccttagaccaaattttagttagctattgtcaactataaagctcattattattcttatgaactttagaatctaaaaagataaatcagtcatttgcctgtttgttaagactttgtctgagccatccctacaagacaggtaaagacagcactcagcacaggactgtggcctacactgatctctccttacttccattatctgcattcacatccatgtcttaaattactgccttctcaaagttaacaactacattagtattttcttgtttactatctttttgttttgttttgtttttgttttttctttttcgagagggtgtctcactctgttgcccaggctggagtgcaatggcatgatctcggctcactgcaacctccacttcccgggttcaagcgattctcctgcctcagcctctggagtagctgggactacaggcgcctgccaccacgcccagctaatttttatatttttaatagagacgaggttttaccatgttggccaggatggtctcgatctcttgacctcgtgatccacccgcctcagccttccaaagtgctgggattacaggcgtgagccaccgcgcccggcctttttttttttttttttttttttgagacacagtctcgctctgtcgcccagtctggagggcagtggcctgatctcggctcactgcaacctccacctcccgggttcacgccattctcctgcctcagcctcccaagtagctaggattacaggcgtgagcccccacgcccggcgaattttttgtatttttagtagagatggggtttcactgtgttagccaggatggtcttgatctcctgacctcggaatccacccgcctcggcctcccaaaatgctgggattacaggcgttagccactgcgcccggcccactctctgttcaactcgggaatccctgtcttcttcctgtcttgaaagcttcagccttctgagacttaagaatacaatttcaggctgggcgcggtggctcacgcctgtaatcccagcactttgggaggcccaggcaggcggatcacgaggtcaggagatcaaggccatcctggctaacacggtgaaaccccgtctctacagaaaatacaaaaaattagccgggcgcctgtagtcccagctactcgggaggctgaggcgagagaatggcgtgaacccggggggcgaagcctgcagtgagccgagattgcgccgctgcactccagcctgggcgacagagcgacactgtctcaaaacaaaaaacaaaacaaaacaaaattcaatttcaaaacccagataaaaactaaatctttggagattcagtgctaaattctcaatttgtgttcactaaaagatgtatacttgggcagtgactaatttgatagttatttcccttggactgataagtacattcctttttttttttttttttttttttgttagacagagtcttgctctgtcggccaggctggagtggcatgatctcggctaactgcaacctccatctcctgggttcaagcaattctcctgcctcagcctcctgagtagctgggattacaggcgtgtgccaccatgcccggctaatttttgtaatttgagtagagacggggtttcaccatgttgaccaggctggtctcaaactcctgacctcaggtgatctggcctcctcggcctcccaaagtgctgggactacaggtgtgagccactgtgccccacccaagtacattcatttttaaacaattaagaagttttgtaatgacttgtgaaatgaggtgatgaaatataattaaagtaatcactattttaatggtagttctccatggaatatttcacaaaattattcagcaccttgttaagtttttaagaactaataatgaaataatataataataaaccaggaacatagtgttataaatagatacaaaatactttagagattgaagttttgtattcacagagatgggagtgaaataaagcagttgttcttataactcttggcactgagactatgtgacctgtgattttgatatatgagagaaaagccagattttatatgcaagatgttggacaatagatttagagagaaaatgtatcagaatacacactgaggcaataattgcctgtttacagatgaaacaggaaagacaagatatagaacttcaaaataaacataaatggtaatacttagcagcatattgagccaatttatttggagaaaataatgaaaacacgcaggacaacactgatgctatagacaaaaatttatattttttccactcaggagactgtttttagtagtttactactagacaagatggtatgttgaataaagctaatgtacttactctgttttgtttctccttttttttaagttctggaataattttcaggagaaagaaaatcataagagtttgtttaaaatttctttttcttgaaacagatttatattattgaaaaattaaataacaggtcactacataaatatccctgaaattttttttttttctttttttgagacggagtcacgttctgttgccaggctggagagcggtggcgccaccttggctcactgcaaccgccgcctcctgggttcaagcaattctcctgcttcagcctcctgagtagctgggactacaggctcgcaccaccacacccagctaattttttgtgtttttagtagagacagcatttcatcatgttgcccaggatagtcttgatctcttgacctcgtaatcttcccgtctcaacctcccaaagtgctgggattacaggcatgagccacagcgccaagccaaaaatgtcggtgaattttcagagactagatccattcagtgaacacagccagggctctgttggatgcaaatgacaaagacacaactcaaacgtactttaactcacgttacaaaatgctaaaggacagaccttagggcataagcagcatctctagaatttagtcttaacctcttccatctctacctttctctgtgttggttccattttatttgtttcctgcaatgactcatatcttgtgattgaaaaacaaggggccgggcgcggtggctcacgcctgtaatcccagcactttgggaggccaaggcgggtggatcacgaggtcaggagatcgagaccaacctggctaacacggtgaaaccccgtctctacgaaaaatacaaaaaaaattagccgggcatggtggcaggcacctgtagtcccaactacttgggaggctgaggcaggagaatagcgtgaacctgggaggcggagcttgcattgagccaagatcgcaccattgcacgccagcctgggcaacagagacagactccatctcaaaaaaaaaaaaaaaaagaagaagaagaagcctggtggatattcatttctgcaagaatactcagggagttctatcatcagggaccttttctagacatggtttgcctctccaggccttgagaaccatatctttctccccaaaacacttttgtttctgagcatcctcagagcccattttttctgacccaaattgctgctcagtaaagggacacagatatttaagggacacagatatttaagggacctgaggggatggtccaaaaagagtaattttctagagtgtccatatatttttaagtaattgtagaggcatcaatcaggatatcactcttcctccattcacccaccaagagattgggaattgccttgttcaatgtcgaaaggctgtcctggctcactctttcagcactctgcaaaagatgagtgttatcgcaatggcattgtgcccacacacacccagggaaaaccgcagcttttgaaaaatgttataaacaaaataactgcattgaattccaccagataaattacagatcatttctttgaaagttaacgccgtgagaacaatgtgtttgattttctgttttctcaaagtaaaagtttagacaagtatattctagtaatatcattttatttttcatttgagacagggtctcactctgtcattcagtctggagtacagtggtgtgatcgcagctcactgcagcctcaacctcccaggctcaggtgacccttccacctcagcctcccatgtaactgagactacaggcatgtgccaccacacccatctgatagtatctatacagatcagagtttacttctatatggtaatggaacaactttgacatgacagaacattcataagcaattttggcatgtaagtaactgttctgatattcgaagctctcaattgtatgataagcaatccaactcaactagttaaacaaaaacctctactatataaacattagagaatcttaccacattttgagtattttagtagctgagtaaaagagacaaaatatatgaacatttaaaatgccctttaatgtcagttaatttttttctatgattataatagtaagagctgtgcgtgtgttctttggtttaaatagcactacattcttctttgatataatttttatatccttcctccctctctctctctctctgtgtgtgtgtatatatacacacacacacaatatgtacatagaatatatatactgacacatacatacattcatatataaaatttgaaattaaaagattaagtatggctgggcatggtggctcatgcctgtaatcccagcactttgagaggccaaggcaggtgtattatgaggtcaagagttcaagaccagcttggccaagatggcgaaaccccatctttactaaaaatacaaaaactagttacgactggtggcaggcacctgtaatcccagctactcgggaggctgaggcagagaattgcgtgaacccaggaggcagagattgcagtgagctgagattgcaccactacactccagcctgggtggagcaagactctgtctcaaaaaaataaaaaataaaataaagcaagaaaatattaagcatgaacataaaaaagaacaagagctggtataattagaattagtgttttgaaacttttctcttaagtacttttggtcatattaatcagttgctctaaaatttcaacatggacattttgaaggtgcacagttgcacacatcccaattgcagagttccagtttggttcagatcaagtaaacacattctgccttatctactgattacactgataatcatggtcaaaatgcataatgttactaacagaagactctgaacgttggataagagtagtaaacattcacccctagacattgccatggggttgaagccctgcagcctgtctgtatgctcccctagaggtttgaccagcggggcactgaagcactgaagaagcaagccacacctccatcacatgccctgcaaaagggacaagggaacctttcccatttcaatagctacacatgtacccctgaacttggtatggagctcaggacctgaaggatgacctagcggtgatttgcctaacttgatttcctccttccttcccttcctctttccttccctccctctcatcatccttcctctttcccttcttcctccctccctctctctctccttcttatttctcctctcttattcctcctcttccacccctccttctccttcttctcagtcttcttctttcttcttatgtattcaagcttgagctctaaaacagactgaaactagaactgcacacaggcagactgaaggagatagagacatgaagaaacattcaaaatatcaacaaatccaggagatgattttctgaaaaaattaaaatagaccactagctagactaacaaaaaagaaaagaaagaagattcaaataaacaatcagaaacaacaagggcaatattaccactgaccccacagaaatacaaataactatcagagaatattatgaacacctctatgcatataaactagaaaatctagtagaaatggataaatgcctggacacatacaccctcccaagactgaaccaggaagaaattgagtccccgaacagaccaaaaataagctccaaacttgaatcagtaataagtagcctgtcaaccaaaaaaggcccaggaccagacagatgcacagctgaatcctaccagatgtacaaagaagagctggtattactcataccaaaactattcaaaaaaattgaggaggagggattcctcccaaactccttctatgaggccagcatcatccagataccaaaacctggcagatatacaacaacaacaacaacaaaaaacttcaggccaatattcttgatgaatgttgatgcaaaaatcctcaacaaaatactggcaaaccgaattgagcagcagatcaaaaggcgtatccaccacggtcaagtagacttcatccccgggatacaaggttggttcaacctacacaaaccaataaatgttattcatcacataaacagaactaaaggccaaaaccatatgattatctcaaaagatacagaaaaggctttcaataaaattcaacattcattcatgttaaaaactctcaataaactaggtattgaagaaacatacctcaaaagaataagcaccatatatgataagcccacagctaatatcatacttaatgggcaaaagctggaagcattccccttggaaactggcacaagacaaggttgccctctctcactactcctattaaatatagtattggaagttctggccagggcaatcaggcaagataaagaaataaagaactttcagatagtaagagaagaagtcaattatccctgtttgcagatgacatgatcatatttttagaaaaccccatagtctcaacccaaaagcttattaagctgataagcaacttcaggaaaatctcgggatacaaaatcaatgtgcaaaaattactagcattcctatacaccaacaaaagtcaagccaagagccaaatcaggaacaaactcccattcacaactgcaacaaaaagaataaaatacctaagaatgcagctaacaagggaggtgaaaggtctctacaaggagaactacaaaccactgctcaaataaatcagagaaggcacaaacaaatggaaaaacattctatgcccatggataagaagaatcaatattgttggccaggcacagtggctcacacctataatcctagcactttgggaggctgaggtgggcagatcatgaggtcaagagattgagaccatcctggccaacatggtgaaaccccgtctctactaaaaatacaaaaactagctgggcatggtgttgtgcacctgtagtcccagctactcgggaggctgaggcaggagaatcgcttgaatctgggaggcggaggttgcagtgagtcaagattgtgccactgcactccaacctggcgacagagccagactccatctcaaaagagagagagagaaaaaaagagtcaatattgttaaaatggccatactgcccaatgcaatttacagattcaatgctatgcctgttaaactatcactgacattcttcacagaactataaaaaaactcttttaacattcatatggaaccaaataagagcacgaatagccaaggcaatcttaagcaaaaacaacaaagctggaggcatcacgctacccgactttgagctatactacagggctacagtaaccaaaacaacatagtactggtacaaatttatttgtacaaatttattattggtacagacacataaaccaatggaacagaatagagaacccacaagtaagaccacacacctacaactatctgatcttcaacaaacctgacaaaagcaggcaatggggaaaatattccctattcaataaatggtgctaggataactggctagccatacacagaagattgaaattgaacttcttccttacaccatataaaaaaattagctcaagatggattaaagacttaaatgtaaaacccaaaactatagaaatcctggaagacaacctaggcaataccattcagaacagtcacaggcaaagatttcatgataaagacacaaaaagcaattgtaacagaaacaaacattgacaaatgggatctaattaaactaaagaccttctgcacagcaaaagaaactatcaacagagtcaacagacaacctacagaatgcaagaaaatatttgcaaactatgcatctgacaaaggtccaatacccagcatctataaggaacttaaactaatttacaagaaaaaaccaaccccattaaagtgagaaaaggacgtgaacagatacttttcaaaggaagacatacatgcggccaacaatcatatgaaaaaaagctcaatatcagtgatcattagagaaatgtaaatcaaaaccacagtgagataccatctcacaccagtcagaatggtgattttttaaaataataaaacattataaactatacctaacatttatagaacactccacccaacagcagcagaatacatgtttttctaagagaaaatgatatcctgaaacattgttcagcagaactgttacaatttctttttaaaaacctgaaatttcttcttttaattggtaatttttttttaacttttattttaagttcagggttacatgtgaaggtttgttacacaggtaaacctgtgacatggggggttattgtacagattatttcatctcccaagtattaagcctagtactcattaggtatctttcctgaccttctccctcctcccaccctccaccctttgagataccacagtgtgtgttgctaccctctatgtgtccatgtgttctcatcagaatggctattattaaaaagcaaaaagcaaaaaaaaaacagatgttggcgaagttgtggagaaaaaggaacaattatacaatgttggtgggagtgtaaattagttctactattttggaagacagtgtgatgattcctcaaagacctaaagacagaaatgtcattcagcccagcaatcccattactgggcatatacccaaaagaacataaatcattttattataaagccacatacacacatatgttcactgcagcactattcataacagcaaggacatggaatcaccctaaatgcccaacaatgatagactggataaagaaaatgtagtacatatacaccatggaaaactatgcagctataaaaaagaataagatcatgtcctttgcgcaaacattaatggagctggaggccattatccttagcaaactaatacaggaacagaaaaccaaatacagcatgttctcacttatagtgggagctaaacgatgagagcatacggacacacagagggaaacattagggtggaggataggaggagagagaagaacgggaaaaataacaaatgggcattaggcttaatacctggatgatgaaacaatctgtacaacaaacctccatgacacaagtttacctgtgtaccaaactgatatggaagtgctgggaagggaagagcgtggtccctttaaatgatagggaaggggagaagggaagtgttgggtagaggaggacgtggtccctggctagggctccacccccacggacctaggtaaggacaggcacttctgctttcatgccgaaatgtagcattttccaagaccaccctggcctgccgtgcccccatcatgggcctataaaaaccagagaccttagcaaggcagggacgcaagcagctggacatcataaggaacacatcagcagaagaagacacaagcagctggtcatcgaaagcacactggcggaagagcaggccaacagacacctgcaggccatcaggccatcgatggagtctcgctctgtctcccaggctggagtgcagtggcgcgatctccgctcactgcaagctccgcctcccgggttgacgccattctcctgcctcagcttcccgagtactgggactacaggcgcctgccaccacgcccaggtaattttttgtatttttagtggagacggggtttcaccatgttagccaggatggtcttgatctcctgacctcgtgatctgcccacctcggcctcccaaagtgctgggattacaggcgtgagccagcgcgtccagccaggacttctttattaagtggtttttcattaaaggcagtgatgttaaatgtgctcttgcaaagggggtttcttctaaggttgctgttactaaggaactgttgctatgggcaccattgctaagaaatgttgctaaagacaatgtttctaaggatattgctaagagttttgttgccaagggtgttgttgctaagaagattgtcgccaagggaattgtattaggttggtacaaaggtgattgcggtttttgccactgaaatggcaaaaatcgcaatcacctttgcatcaacctaataattaaggacattgttgctgcatatagtgttgcaatggattttgctcctagggcctcttagataagggtgttgttgctaagaaatgttccccacacatactgccaccaaggacatagttgttactgccactgtagctaaatgcatggctgatatagccattattgctctggtcacaattacagtagccactcttgcagaaggagcaattcctatgaccaccgttgctaaagacattgttattaagtatgttgctattaatggaactttttcaaagagtgcggttgctaagcacattttgtcaagtttttgctaatgatattgttgggagggcccttatgctaaagacatcgctcttaaaggtgttagtattaagggtggtgttgcaagaaagtttttgctaaggatgcatttgctaaatcaaggttggatggtcactactgccacgaaaactgttgctaaaggcaacattgctaggggcaaaggtgctaaggaaatttttgctatgaaatgtgttgataagattgttgataggcagtttttagaaaggcactttctttgttagtattagtgtgttttgtgttttcttagtatgtttgttagtgtgttttggcgtgctttgctaagaaatctgcactaagttgcttttgctgagggtgtggctgctatggccactgttggcaaagtcattgttgagaaggcattatttctaagtttattattgctaaggaaattgttgcctttttgttaagagaattgtattagtttcctagggctgccatatcaaagtaccacaaacgaggtggcttaaaacaaaagaaatttctcttacagttctggagcttagaagtccaaatcaggtggtggtagggttgcttccttctgagcactctgaatcttttccatgcgtttttccttgcttctgatggttcctggaaatctttcacatttcttggcatcactccagtctctgcctttgtattcacatgcccttacaaaacttactctctgttgctaggagcgtgtttgctaaggaaatgcttgctaaaggtatttttaagggcatttctcttaaaggcattaatgttcaagatattgtcacagataagttttggtaccaatgcaattaccaagagtgttgatgttatggccctgttgcaaaggaaacttgttgttaagggtgttgcaagactcttgtgttaatatcgttgtaaagaaagttgttgttaaggatgctgttcctaagtgcatttgtttctatgttgcaaaatgagatatgttaaaagcattgttgcaaaagatgttcttgctgggagcattgctgctgatggaaagtttgcaaaggtaattgttgatggaagcaattttgaaggtcctcttttttttttttttttttttttaaaaaaaaaacaggcagagtctagccctgtcgcccaagctggagtgcagtgttatgatcatggttcactaacctcaaactcttgggctccagcaattttctcacctcagcctcccaagtagctaggactacgagcacaggtcaccatacctgacttttttaaaaaattttttgtagagacagcatctcactatattgcccagactgacctcaaactgccggcctcaagcaaacttcctgcctcaacctttcaaagtgctgggattacagacattagtcaccatatctggtcaagattgtcattcttaaaggcattgatattaaaagggttattgaagattaaggttttgctatgagtgctgttagtaactgtactgttgctaagaaagctgttgttaagggcatttttgataagggtactattggtaaggttattgttcttaagggtattgctatggtttggatgtttgtcccctctaaacctcatgttgaaatttgatccccaatgttggagatggggcctaatgggaagtgtttgggtcatatgaccaaatcccttattaacagattaatctccttccttgaggctgagtgtgtcgtctatcagttcctgccagagctggttgttaaaaagagcctgagacctttctgctctctttctctctctctctcatcatgtgagctctgcacacaccagctccacttcatcttctgccatgagtggaagcagcctgaggccctcacctgacacagatgtccaatcttgaacttcccagccatcagaattgagaaccaactaaatagtttttctgtataaattacccatcctcaggtatttatttcgagcaacacaaaatggtataaggcaggtgttgatgtcaaaaaagttttgtaagggcattgttctttaaggccttgaagttattgtgcaaagaaagttttgctaagggtgttattgctatgactagtgtttctaaggaaactgttgctaaaagcactttttttctcagagcattattcctaaggacttaattgctaagagaatggtagtaataatatttttgccaaggttgttgtggctaaggaagtcattgctgagggtcttttgttaaacatgctgttcttaaaggcatttttgttttgttttgttttgttttgttttgagacagggtctcactctgtcacccaagctggagtgcagttgcgtgatcacagctcactgcaggcttgaactgctgtgctcaaagtgatcctcctgcctcagtctccaaagcaactgggacaacaagcacacaccaccatgcctagtgtattagactgttctcatgttgctaatacagacatacccaagactgggtaatttttaaagtaaagacatttaattgactcacagtccccatggctggagaggcctcacaatcatggcggaaggcaaaagaggagcaaagtcacatcttacatggcagcaggcaagagagcttgtgcagggaaactcccctttataaaaccatcaaatttcatgagacttattcactattatgagaacaacaagggaaagacccacccccatgattcaattaccttccattgggtccctcccataacacgtgggaattatgggagctacaatgcaagatgagatttggatggggatacagccaaaccatatcatgtagctagctttttaatttttttaatttttctttttgtagagatgagatctcactacattgcccaacctggtcttgaacccttggtctaaagcaatcctcccgatcccacctctcaaagtgctggaattataggcatgagccactgtgcccagccaaaggcattgatgttaatgttgttgttggatgtttttgctaaaggtgctgttactaagaacattgtggccatggccactattgcagaggctactgttgctaagatcattggtgctaaaggtgctgttcctaaggaaagagtgttgaatttaaagaaattgttgttatgggctattttcttagagtcattgttcttaaaggccttgatagtaagagtgttgaaaataaaacagattttgctacgagtgatgttgataagggagctgctgctatgagtactgtttccaaatgtgatgttgctaagagccaattgctaagggtactctagctaaatacattgttaataaggacattgctgcaaatagtgctgctcacagagttgttgttaatggtgctgtttctaaggacactgttgatactgcaccaatgctaagggcctggttgttcatggcatttttattaaaggcagttataataatgaggttgtttttaaggtgttgatgccaagagtattgtttctaaagatatttttgctaagcatgctcttgctgatggccttgttttatagccactgtttctatgggaaatgatactaaaggtgttattgcttagggcattgttgctatggttggtagccaagaaaggttttgctaaattggcttttttccaagggtgctgtgcaaaggttgttaagtactgtggtaaggaaaatattattatgaatattattgttaaggccattgcctataagagttgctaaaggacattgtgagtcctttatcctatataaatataaaggatatttatattaagcacattgtcactgaggaacttgctgctaggtgttttgttgatgtggcctattgttgctaaggatattgtcactctgacaatgatattaggggcattgtagctaaggacattgacattaaggctctgttactaagactcatttttgctaagggtatttttgctaaggatgttgttattaagtacatttttgctagagcattcttgttcagtgtgttgttgctaaagggctagttgctagaagcacttttcctagaataattgttgcaaagagcattcatgctaaaatgttgatcctaagaccactgtttctaagaaactcatttgaagggcactgtcactgtgagtgtcgttgctaaggttgttgttgtaaagtcctttatggctaagggcattgttactatgttcattattgttaagtgtattacagtaaagaggcattgctactaaatacactgctgttaatgactctattgctcagggacttaatcctaagggtattgttgcaaagagagttaaggatgttgatgttaaggtattgtttgaaagtgtgctgttggccgggcacgctggctcatgcctgtaatcccagcactctggaaggccgaggccggtggatcacttgaggtcaggagtttgagaccagcctgaccagccaacatggtgaaaccccatctctactaaaattacaaaatcagctgggcgtagtggtgcacacctgtaatcccggcttcttgggaggctgaggcaggagaatggcttaaacctgggaggcggaggttacagtgagccgagatcacgccattgcactccagcctgggcaacaagaaggaaactctgtcaaaaagaataaagtgtgccgttattagaatcattttggctaaggggtattggtttgaatggtggtattgctaaggggactgatgccaaaggcactcttagtaagtgcaactgtcgctgaggttgatgttccaaaaggcattgatgttaaggacattgttgctaagcctgttttttaaagtgtgctgctgttatgggtattgttgttaagggtgttgtaagagaaatcattgctgagtaccactgctgctgagagcattgccactaagatctaatattgccaaggacagtgctgctaaggccgtttaacttaaatgcattttagtaaaggcattgttcccaagactattgttaggggctgttacgaaggaactgtgttaaagatattattgttatagtcgttaaatctaagagttttgatgttaagggccctgatgctagaaatacgtttagataatttttactacaactcattatggctaagaatgttgatgttaggtacattattgcaaggcacttttgtaaagtgtcttgttgctaaagtgattattgctaaaggcactgttgctaaggggactgtttcttagtgaatccataagagctttgttgctaagggccatttttgctaagaacattgtttctaagggtgttgaagttaaacacgttattactgaaagcactgtggtaaaggcatcttacctaagggtttactgctaatagcactgttactcaaggaactgaggctaagggcattgttgctgacggggttgttattaagggcatttgttatgaaaggtcattgtgtctaagtacaattgtttctaaggacattgtttgaagggcattatttcaagggtcattgttgctaagagcattaatgtcaccgacagtgttgttcctaagggaatgttagtaagagcattgtttctaagagtattgttacaaaaggactcttgctaaggacattgttgcaaatacattttggtaaaggcattgttcctaaagggattctggctaaggacactgttacaaggggcatcttttataagggcattgttgctaaagttgattttaccaaaggccattttagctaaaggcactgttgctaagtacactgttgtcaaggatgttgttgctaagggtgctgttgttaagagcattatgttctaaaggatccgttgctaagggaattgatgataattgcgttgtttcttttttcttttcttttcttttcttttttttttttttttttagatggattctccctctgttgcccaggctggagtgtggtggcatgatctcagctcactgcaacctctgcctcccgggttcaagtgattctcctgcctcagcctcccgagtagctgggattacaggcgtgcaccaccatgctcagctaattcttgtatttttggtagagatggggtttcatcatgttggccaggctggtctcaaactcctgacatcaagtgatccacccacctcagcctcccaatgtgcttgggattacaggcatgagccacgttgcccggcctgtagttgcattgtttctaagggcctttgttaaggcactatgctaatgtttttgctaaaagtcattgttacaaaagctgtggttactaatgatgttgctgccatggaacacgtgcctaagggcgatatttcaattggcatcgatagtaaggtcactgttgctaaggaagttatttctaagtgcattgttcctggagccattgtagttatgggtgatgttcataagagaactgttgaaggtcattgtggctaaaggcattattactattgctagtgtttctcatgatgctgtttctaccagcactgatcctaaatctcgtgttgctaagagtattgttactgagggtattactgctaagtatgttgttgcttagggtactattgcttagaatgtttttgtatattattgttaaggacactgtttctaagatcattgttcctagggtgttaatgttggcaagggacatttttgctgaaggcattgtgactaaaggcattgttgttacaggtattttcttcaaagggcattgttgggaaggggacatttctagagtcactcttgctaaagactgttgctaagaccattttactaaggtcaatgctaacagcattattaccaaggctttatttttatggctcactgttggttgctaaagtcattgcttctaagggccaagagggctgttgtcaagaatgctggtcttaggggatttttgctaatagtaatattgttaggacattgttgcaaagagtgtggttgctaagggccattgtttataaggtaaacaatggtaaactcttggtaaggcaagtttggataagagcactgttgctaagggcactggttataggggtgatgcgcatgatttttttactaaggacattattaagaatgtcatttctaaggtcagttgtttacccctttcttgctaatggtactgatgttaagagtgttgattctatgagtattaccattcagagcatttctccaggagccattgttgctaagttcattgatattatgtattttgtagctagggcattgctgtaaagtgtgctgttaccaacaacactgttgctgatgtcattattgctaaggagttgatactaaaagcatttttactaaggtgccattggtaagagtgctgttgttaatgccactataaaggacatttttgtaagggcattgttgctaattgctttatttctaattttgttattgctaagggccatggtttttgaaggtattatttctaagggtatttttgctaagatacactaacaggccatggtttgcccatttccaaagtaccatggcaatttatagaggtaaatggacataccattgttcctaagggcattgttgctatggacattgattttaaagacattgttgccaacggcattgttgcaattggcataattcccactatttctacaggcaattatgctaaggctgttgttgcttagagatttgtcagtaaggtgcaccattgctaatgatgttgctgctaaggacattgttgttaggggccattgttgttatgttatgagtgttgtctctagggtcattgttcctaagggccatttttgttaagggtcttgatgctaaaggccatttttttaaaggacattttggtaaaggtattcatttcaagctatttgttgctaaggtcattgttgtttggggtggttgttaaggtccatgattgctaatgtaagatattgcttctaggagtgttaatgtcagtcaaaggtgttgctaagagcaactgtggcaaatagtgttatagctgagggcatttttctaatgttactgttgcttagattatgttgccaagagtcttttggctaaaagggttaatattaacaatgttgtcttaaagcattattcctgatggtgtctatgctaagggtattgttgctatgggatttgttgctaagggccattattaacaagtcattgttgtgataggcatatttttaaaggtgttggtgctaagggcaattgttcttaaggatgtttttgccaagggcattagtggtaaaaaattgttgcgaaagccatttttttctaagtgggttggtcctaatgtatcccacaccatgaaatcactacctcactactcttcacctctcccactccatacaccatatttccttgtatcagacacctgctgacatcaccagtataggatcttattagaacaaatgaggcaagtagagcaaagtgggcatctctcagggaacaagagtgtccagtgcaaagtatcagcccattccaaccttaggacaggtgccaggctgattaggggcctcaggtttgagctagtgaccctgaccctttaagctctgagaacttaaagctggctgagctccaaccctaaatgttttgtcctatgagtcattatctgtgagctatttttaaaaatattttggacttcatctatgtttttcccctaatgtgtttgaattttgtggggactctagtggaaacagaggaagtcattgattgttcttaaatcttaaatgcatctttccaacctgtcaatgcacataacttaatcaggtctatgttcatgcataagatagttccatacatgaagcatctcacacttcaatatgctctctatatacaatatttttccacttaaaatatccactaggttgagtgaggacatcgatagccagattttcacatatatttgaaaaaaagagaggtaagaaaactcaaaaatatctgtaaaagaaacaaacacatttggagcacgtgccttactaccaatcaaggtttttgaaagccagactcatcaagacagtggtataggcacagtgagagacaaagtagctcacaggaaaagaccagaggcccataatcatacttagcatttatatccacatggtgtcttacagaggggacacacacatcagtgaggagagaaaatgtaatttaggattagcatacttggtgattaactggtttaaaaaaaatgtgtaattgttaaattaaaaatataaataacaaatttttcaatagcaaactcaaatgctatgaacttaggggtaaatttcaccaaagataaaaagtattttatagtcccctcactattgtaagaaatttaacctaccctgggagatgaatactatggtttcaccattttaaaggtgaacttattcataagagaaaaaaaataaaagcaaataaatggagatttatactgcaaatatcaataggaaaagttgaaatcataaaaaatatcaattccacccaaattgtcaatgttaattccagccaaaacctcaaccagatttcctaatgtccttcataagctgatgcaaaattaatatgaaaaaataaacctcacaccaaagaaaaccaaagacactctcatgcagtaataacataagagaaattatctactggaccttacaatttatgatgaaaataaattaattaagatagctttgtattggaaaaaatagagacaagccaatgaaactgaagaaacaaaatggaaacagatacctatgagaaagtggaaacagcagggcaatttagaaagatgactattttaaaagctgtcatggccgggcgctgtggctcacgcctgtaatcccagcactttgagaggtggaggcgggcagatcactcgggcggatcacttgaggtcaggaattcaagaccagcctgaccaacatggtgaaaccccctctctactaaaaatacaaaaaactagcctggcgtggtggtgggcacctgtaatcccagctacttgggaggcagaggcaggagaatcgcttgaacccgggaggcggaggttgcagtgagccaagatcacaccattgcactccagcctgggtgacagagcgagactccatctcaaaataaataaataaataaataaataaataaataaaataaaagcagttaaaccattcagatatccatattgaaacattgtggatccgtacttacgccttacactaaattcatcccagtgggattaaaaacttaaatttgaaacaaaatatgtgagtcatttagtaaaaagaataagagaattttcttatgaatactgtctgaaacaaaaccacaataggaaaagataatttaactcttccacattgaaaagaaaaaaatctctctttttttttttttttgaatggagtcttgctctgtcacccaggctggactgcagtggcgcaatctcggttcactgcaagcccagaccccgggttcacgccattctcctgcctcagcctcttgagtagctggtactacaggtgcctgccaccacgcccggctaattttttgtatttttattagagagggggtttcaccgtgttagccaggatggtctcgatctcctgacctagtgatccgcccgccttggccttccaaaatgctgggattacaggcgtgagccaccgcggccggccagaaagaaaaaacatcttaaagaaaacctaacaaagtgacaaccaatcttcagactggtagaaagtatttgcaatgtacagatgccacaaaaaatacccagaaaatataaggaatttctagtatcaggagtatattttattgattgccttgaatgctcaataagatcaagaaacatggaaatttataaaactaaatgaaaattcattctatattcttgaatactataattcactgaattatgtatatagtaatatgtaagataataatatataactcatgattttaagcttttccattttcttttctttttttttttaagacggagtctcactctgtcgcccaggctggagtgctgtggcacgatctcggctcactgcaagctccgcctcccgggttcacgccattctcctgcctcagcctccccagtagctgggactacaggcaccagccaccgcgcccagctaattttttttatttttagtagagacggggtttcaccatattagccaggatggtctggatctcctgacctcgtgatccgcctgcctttgcctcccaaagtgctgggattacaggcgtgagccactgcacccagcctccattttcaaattgatagatatattcagtgcatttcccctaaaaattttcactgtgttttttgagtatttaaacaactattaataattcttaacttcgtacaaaaaaagtcaaaggccgaagaattgaaaacaaatctgtagaataaaaataataataataagatgtaaggaactgccgtacaccaatcaaaatccataatgttagccttcaagacagcatggggcaaatctcctgataaatgaaatagcccaaaggaaaaaaaatagaagtccagtaaatgactcagaattgagtcaatagacatttatggcagatggagcactgtacatcagtggggagacataaatacataggactggggcacttgctcttccaaattcttcatgactccctcttcattgagccctgagggaaatggagagagagaaaagtaagtcggggacaggtgagaccattcactcccagatgcacctctatttccacatcttcaacttagcctcattaagtgattttgtaaacaagctgagaataccagatggctatggttcactttgtttgtgtatctccccaatgccaatgtgactgcttcaatagactatgtcacagatatgttgcttgtaatatttgacatgatgtgagtttttattcaagttaagcaacagccatgagagacaagcacagagagcctatccatgtgtttctgacaaaggttccttttttattgttttatgtttatcaagagatttcttttgacacatgtactttttaaaattttttattttgaaataattgtagattcacatgaagttgcaaaaagaaaaaaaggtacgcaaaggtcccttatacatttcaccaagcgtaggattattgttgagaatatgataaatcgcacattcagcctacatagataaatgttctatggttctactagatatatggttctacatagataaacgttcccaggtctctggggctctctcttacagagaggctaagcatgttttctaacacaatatgctagacatagctgcagtattagtcattcaattattaaacttaataaaacttcaaaaaatattgtatggcatatgtgtgtatgtctgtgtgtgtatacacacagacacacacacacacaaatgcaaaagactaatactctattgtaccaaattatgtttaaagaattcaagagaagcaacccctgtgtagacaacagatgcccagattgttcgtatgtttcaaggatatgtgaaggagtttgacgactgctttctcatttggagagaaattaagctgactcttgcagtgacttattctacattagtttgtagatctcggtgattcaattgcctcttctgacaattttctttctcagagaaccccaataatcatttctcatgtgcttaactatccccaggatcttcctatataaaagccattctctatcaaatctttatacttaaggaaagtttgagtacagagtacagtccagtggggccagtgttttccagccaggtcctatggccaaaactttctacaatggcatcttaaatgcaattagcagaaggctgatacctccagaagtaacaaccaagttgctcacttagagtttcaggaagtcagagttcatttgtgggcaaaggatgcaggttacagatattgctcttataggttaagaaaaggaaagaaaacccagcaaagtcaaccatctttctggaaatgttgaaaaaatgtgagaaaattccattttttttttgagacggagtcttgctctgttgtatttttttagtagagacggcatttcaccatgttgaccagaatggtctcgatctcttgaccttgtgatctggttgcctcggcctcccaaagttctgggattacaggcgtgagccaccatgccgggctgaaaattccattaaattttaactgtagagcttcttgctcacccctaggagttagaaacttgagaaggcaagctcatccagagttggacaagtcccagctttaaatagagtctcagggaatgaggtcaagtctttgctgggggtcttgtagatgctacacatgcaggtcactattctgagtggagggttttctagcacctagtgtttgtgacactcttgttggaaacaagttggaaaaaagagatctctgtaaaatttgagggagctaagtctaaatctgactcataaacccatcagaagcagctaccttgtgaatttaaacagctctgggagaaattgtgtgaatggaaaaataattccaagttgttgagtctaagatcactgtcttgagccctgggttagatatagacatacaaggtaaatgatgtagaaagagaaactctaagctggtcatggtggttcacgcctgtaatcccagcactttgggaggccaaggcgggtggatcacctgatcgtcaggagttcaagaccagcctgaccaatatggtgaaaccccgtctctattaaaattacaaaaattagctgggcgtggtggcgggcacttgtagtcccagctactcaggaggctgaggcaggagaatcgcttgaacccgggaggcgaaggttgcagcgagccgagatcatgccactgcactccagcccgggcaacagagcaagactccgtctaaaaaaaaaaaaaaaagaaagaaaagaaaaagaaaaagcaactctaaactgttaatatctgagttagctcaattcttcaaggttcaggaagatttaaagaatcacttttactttaagggttaaaataaaaagattcctgaagagttttgtcataatcccattagttacctgcatagtttcctagcttaagacctgggggaaaaattgactcaaatctaaactatctttagattaggagcattaaagaacctgcatcctggaagaaacattccagacacagttggacaaataattcaatagctgtctacaaggctgtctatacattttagggaatccttcagtgcttaagagacaaatctcacttattcctcagtcccttaacagctttaagaagaattctcaatttccccgtgcctgcaatggctctgtgtggtagcacaggtaatgcctaggaggagaagcttggaaaattgtaagacctgggggttataagcttcataatttgttcagacatcccatgatattttcctgctgctccaatcaaggttagtgttcagggtcggactgcaggatcatttctgagatcaaaaggcaaagcaagggaagggcaatgcagttgcaatttgtgcaagaagttaaaaagagaaatttattctcaagcaaaatgatttttcatttattcatttttactgagtttaaacagatttttgggcaagtttagctatcacagctgtgattgtcacacccctctgtctctgtctgaggccctggaaaagaaagtaacagagtgggtttaacatgtattgccaatttctcattcctaagagaagtgaggtataattggcatacaattaactgcacatatttaaggtgtacagtgtgatagtatttgacacgtgtaaaacacaggaaactatcattaaaagtcaagaattaatatctgtcaccccaaaatgttcctgttgccctttggcaagccttctcttccactcctctctatcaaaccagggtagaagggtcttacatgttttgttgctcaaatttatccctaagtatttgatattttgctgctattgtaaatctcctggctatttttttttttttttgtatttttagtagagatggggtttcaccgtgttagccaggatggtctccatctcctgacctcgtgatctgtccgcgttggcctcccaaagtgctgggattacaggtatgagccaccgtgtatggcctataaatcataattttaaaatacaatttctgattgttcattgctagtataaggaagaaactttgtatagtcgtattctatccttcaactttgcttaactaatttgttagtactagtagctttatcagcttattagttaataataattagtagcatattaatttctgatagtttttgtgtagattccacaaaacttcctgtcatgttacctgagaaacagaaacaattttgctttttttccaattcacctgtgtgtttttctcttttcttttggctttattgcctcaattacaatgttgaatagaagtggtaagagctgacattctcatctcattcctgatctcaggaggaaagcattcagtctttcaacattaagcgtgacattacctgtaggttttttgtaaattaccttaatcaggttgaagaagtttcctgctagtgccagtttgctgagagttattttcttctgattatactgagataagatcttttcttttttaatttctcaatttggtgaactacagtgcttgatttttaaaatttttattttattgtggtaagaatataacatgagatctactctcttatgagatttttcagtatacaataaaatatggttaactataggcacagtattatacagcagatctctaaagctaattcatcttgcattaatgaaattttatacccattgataagcaactcctcacttccctttcactcccgtcctggcaaccaccattccactctttgattctatgaattgtactgttaatattttcactatctaagataagcaaattatacgggatttgtctttctgtgattggcttatttcacttggaataatatcctcaaggtttattcatgttgtgcatattgcagaatttcttttttaatgctgaatagtatttccattgtatgtctataccacatttgctttatgaatttatctgttaatggacattaatgttgtttctacatctgagctattacgaatagtgttgcaatgaacataggaatggtaatattacttcaagatcctgatttcaattcttttggataaatacccagaagtgggattattggagcaatataatggctctgtttttaactttttgaagaacgttcattcttttttcccatagtaaatgcaccatcgtgtattcccacaaacaatgtacaagggttccctttctccacatcccttccaacacttgtcttttttttaaataatcatcatcctgacaggtgtgaggaaatatttcattgtggttttgatttacatttttctgatgattagtaacactgagcatcttttcatatacctgtgggtatttctcttctttggaaaaatgtctattcaagtcctttgctcatttaaaaaatcagattgttagttttatctactgagttgtttgagttcctgacgtattttggaaattaatctttttcccagtgttttcttatagaagctttacagtctcaccttgcatttaagtttttaatccattttgatttaatttttgtgtatggtataagacaaggatccagttctactcttgcatggagatatccagttttcccagcagcatttgttgaagagactgtcctttcctgattgtgcattcttggcacccatgtcaaagatcaattgactgtatatacacagatctatttcttggctccctattctaacccattggtcttatatgtctatctttatgctgttaacatactattttaattactatagctttgcaatatattttgaaattaggaagtgatgcctctagccttgctctttcttctcaagattgttttggctattcagggtactttccaattatatatgaatcttagaattgttttttctctgtctgtaaaaatgctattaggatttttatggagattgaattgaatttgtagattgctttgagtagtgtagatattaagacttccaatctatgaacacagtatgtctttccatttacttgtgtccttttaaatttcttaaattaatgttttgcagtttgcagtgtgtcttttacctccttggctaagtttattcctaagtatttgattatttttgataatgttgtaaatgggattggtttcctaattttctttcagagagtttatttttggtgtatagaaatgcaattgatttttacatttttttatcatactactttgctgaattgacttattaattctaacagttttttgtggagtctttagagttttctgtatattagatcatgtttaaacaggtacaatttcacttcttccttctgaacttgatgtattttttgtattgatcttgaataatcattctgggcaggactttcattactatgttgaatagaagtggtaaaagtgaacatccctgtctttttcctgatattagaggaaaagcttttagttttttacttctgagtgtggtgttagctgtgggattttcatatctggcctcaatatgttgaggtaacttccatctcttcctagtttgttgagagtttctaacatgaaaaagtgtcaaattttatcaaattattatttttaaatctattgagatgattttgtgatttttatcttttattctattaactgtatcccattaattgattttcatatgttgaaccatccctgcaactcagggataaatcccacttggtcatggtgtatgatcctattaatttgctgttaaatttggtttgcaattattttgttgaggatccttgcatctatattaatcagggacatagacctgtagttttctttttgtagtgtcttttgtctgtctttaaattcacataatgctggcctcgtgaaatgagtttggaaatattctctcctgtttgattttttgggaagggttttaaaatgattggtattaattcttctttaaatatttggtagacttcagcagcagagtcatcaggtcggaggctttgctttgttgggagttttttttattactgatttgatctccttattcactgtttgcctgtttaaatttcctatttctttcatgatgcactcttggtaggttgtatgtttctaggaatttatccatttcttctaggttattgagtttattggtgtattttttctcacagcagtttcttatgatctttggatttctgtgacatcagttgcaatgtctttttcatttctgtttttgtcttccttcttcttagtacactgtttgatgtttaaatgttaaaacaatttcacattcttaggataagcccccttggtccttgtgtgttattctgtttacataatgctgtaatttatttgctaaaattgcattttttcaactaatgtcatgagagatattgtctctagtttacttttcttgtaatgtctttgacatttatatcagggtaatgctaatttcatagaatgaggtaggaaataattaccttctcaaaaattttctatgaagagttcatgtaaaattagtattacttcttaaatatttgatataattcactagtgaagccacctgggcctggcattttctttatgtgaaggttttgtaactacaaattgtatttctctaacagatgtagggctattcagattatgtatttcttcttgagtgagatatggtagtttgtgtatttcaaggagttcatctattttatgacaattgtggaaatcattgacatgaagttatatataatattttattatgattcttttaacatctaaaacctaaaatcatgtcacctttctcattcctgctactggcatttttttcttctaatgcctgattaatctggctagatttatcagctttctgttgatttctgttaacatggtatgtattttttaacctatttgtttctttatatataaagtgtatttcttgtaagcagcatagaatcgggtcttcctaaaaaatttatatgacaattcctgacttttaattgaggtgtttaaaccatttacatttaatatgattatttatatagttaggtttgagtcgataattttgatttttgttcttttttcttcttttcttccatttggatcaaacatttttattacatttcatcttcctttctggttcattaactatgtaaatcaaaagtaaaattctaagcccatcaaccaattgaatggacccctcttctcaaacaagggcattcctaagttaacctggaaaatcagttcaggccatgatgggtagtagaggtcagacatgccacactatactcacgttcctttgggattcaggcacagctgaccagcatttaacattaaaacagagaccttacgactgatgaaacagactcttggtagccattaagataccaacatgacagacagcaagccctaaaagaaataaaaatattttacctcaaaagatatttcttttctctccttcttcttctttttctttgagatgaagtctccctctgttgcccaggctggagtgcagtggcatgatcttggctcagtcaccacaacctccgtctcccaggttcaagtgattctcctgcctcagcctcttgaatagctgggattacaggtgcccgccaccattcctggcttatttttttgtattttttgtagagacgtggttttgccatgttggccaggttggtctcaaactcctgacctcaagtgatctacctgcttcagcctcccaaagtgctaggattataggcatgagctaacgtgcctggctaaatttcttaaacatattttgaaatggccctgcaaagctgtctcttgtgggaaaatctaccttctacagaaaatctccttttatttccaggtcttcttcctgatccgggagagaattaactgagtttggtacctttttaagtctgataaaaaacatttacaatctattctttctgaagcctgctacctggaggctttatctgcataataaaaaccttggtctccacaaccccttattttaacccttctattaattccagggctttagataaaagctttcaaccaattgccaatcaggaaatcttttaatccacttatgacttgcaggccacaacccccccactgccccttcctcccccttcacattgctccatgtgatggttaatattgagtgtcaacttgattggaatgaagggtgcgaagtgttgttcctggatgtatctgtgaggatgttgccaaagacgactgacatttgaatcagtggactagaagaggcagacccaccctctatctgggtgggcaccatctaatcagctgccagcacagctaaaataaagcaggcaggagaatgtggaaggactagactggctgagtgttctggccttcatctttctcccatgctgtatgcttcctggctttgaacattggactccaagttcttcggcttttggacttttggacttacaccagtggtttgccaggggctcttgggccttcagccacagactgaaggctgcactgttggcttccctatttttgagatttgggaactcagactggcttccttgctcctcagcttgcagatggcctattttgggacttcaccttgtgacagtgtatactccttaataaactccctttcacatataaatttatcctattagtcctgtcccactagagaaccctaatacaccccaccttcccagacctaaccagtgtatgtcttacatgtactgattcatgtcttatacctccataaaacatggaaattcaagctgtagccagaccaccttgggcaaatgttctcaggacctcctaaggctatgtcatgggtatgtccttaaccttggctaaataaacttctgaattgattgagacttgtctctggtattttttggcttaaaattataattctttattttgctaattttgtgtttgctgtggggtaatagtatatgtcttaaacttatcacaatctagcttcaagtgaattataccatttcacatatactattcaaaccttacaatagtatacctgcatttctcccctctcagtctttatgcttttttgtcatatactttatttgtatatacatatgttgcaataacaacacattgttatcattcagtttaaccaattatctttaaaagaaatttacatgaggggaggttccaagatggccaaataggaagagctccagtctacagctcccagcgtgagtgacgcagaagatgagtgatttctgcatttccatctgaggtaccaggttcatctcactggggcttgttggacagtgggtgcagcccatggagcatgagccaaagcagggcagggcattgcctcacccgggaagcagaaggggccagggaattccctttcctagccaagggtagccctgacagacagtacctggaaaatcaggacactccaaccctaatactgtgcttttccaatggccttagcaaatggcacagcaggagattatatcctgtgcctggcttggagggtcccatgcccacggagccttgctcgctgctagcacagcagtgtgagatcaaactgcaaggtggcagcaaggctgggggaggggtgtctgccattgctgaggcttgagtacataaacaaagaggccaggaagctcgaactgggtggagcccaccacagatcaaggaggcctgcctgcctctgtagactgcacctctaggggcagagcatagctgaacaaaaggcagcagaaacttctgcagacttaaatgtccctgtccgacagctttgaagagagtagtggttctcccagtatggagctggagatctgagaatggacagactgcctcctcaagtgggtccctgacccacgagtagcctaactgggagacacctcccagtaggggccgactgacacctcatacagcctagtacccctctgagacgaagcttccagaggaaggatcaggcagcaacatttgccattctgcaatcgattagcaataacaaacttctccacatttattcacattctccacagaattcaaattattccatttttaacttcacattctacagtgagtttttctataggtaaatattttcttatatatgttctataaaatttttgatattacaaaacagaagcttggtacatcagttctaggtgaatattttatctccaattctaaaactgacatatttcctcagaaaaaaatacctaggaaaaatgtcatttattcaaaatatgaaattttattataattgatgtttaatgcaattcactttacgaaggtttttgtggttttccctaaaatttctgttttaatgaaggctcctgatcatcctggatgtcgacaagttttcttcttcatgtgacgtctctgatgcacaataaactgattagtttttctaaaactgattatattcatagggtttcatctcactctaacataaagtttaagctaaactacgtccatttaactaataagccaaatttgtaagagcttaacagactataaacttaactcttgctttaaagcaacaaaaacaaaaccctgatgaagacctggaagtgaattgttcgtttttcagactctagcttccttgaccttgtgctctatggttttgaacacacaggacccaagtttgctgcagaaataacctccaaatccatcttatgaaccaggaagactgtgagggtttttcttttttttttttaagggccaagggtaaatgtaatatttatcattagcaccacatcccatggtcagccccacctgaataaacggcatattgggatttttccacaaactatgagcctaatgaaaaaggaaatggataagggaaacaagttcccagcctatgtcacatgagtttctgcactacgtgttatgtggtaaggtatgcattccctcaggacttcccaaatccattacatgctagggttttctctctggtatgcattctggtgtgatgtaccctaagagctgccttacggacaaaagttttcccacattcatcacattcatagggtttctcccctgtgtgaattctctggtgtactctgagagttgaattttgggcaaaagcttttccgcattcattacactcatagggtttctcccctgtgtgaattctctggtgtgcactaaggtgtgatttctgggagaacgttttcccacaatcattacattcataggatttctcccctgtgtgaattctttgatgtactctgagggttgaattatgggcaaatggcttcccacatacattacattcgtagggtttctcccccgtatgaactctctgatgtgcactaacatatgacttctcagagaaggttttcccacattcactgcattcatagggtttctcccctgagcgagttctaagatgtgctctgagatgtgatgtcttggagaaagtcttcccacagtcattacattcatagggtttctcccctgtgtgaattctgtgatgtgccctgagggctgaattatcagcaaacgttttcccacattcattacactcatagggtttttccccagtatgaattctctgatgtgcacagaggtgtgttctttgggagaaagttttcccacattggttacattcatagggtttctcccctgtgtgaattctttgatgcactatgagggctgccttatagacaaaagttttcccacatacgttacattcatacggtttttcccctgtgtgaattctctcatgtccactgaggtatgatttctgggagaaagttttcccacacttgctacattcatagggtttctcccctgtgtgaattctccgatgtgtactgaggcgtgtcttctggaaaaaagtttttccacattcactacattcatagagtttctcccctgtgtggatattctgatgtgctctaagggctgaattatgggcaaatgttttctcacattcattacattcatagggtttctcccccgtgtgaattctctgatgtattttgagggctgaattatgggcaaaagttttctcacagtcactacattcatagggttttctacctgtgtgaattctctgatgtgctctcagggctgaattgtaggtgaaagatctcccacattcattacattcatagggtttctcccctgtgtgaattctttgatgtgccttgagaacagaaatatgggcaaaagaccttccacattcattacattcataaggtttctcccccgtgtgaattctatgatgtgctctgagggctgaattatgggcaaaagttttctcacagtcactgcattcatagggcttctcacctgtgtgaattctttgatgtgctctcagggctgagttataggtaaaagatttcccacagtcattacattcatagggtttctcccctgtgtgaactctctgatgtacactgaggtgtgtcttgtgagagaaagttttctcacattcaacacattcatagggtttttcacctgtgtgaattctctgatgtgctctgagatgtgatgtcttggagaaagttttcccacattcaatacattcatagggtttctcccccatgagaattctctgatgtcctttgagatgtgatgtcttcccatattcactgccaccacagagttccatctctgcatctgttttctggtgtcctatgaggggtgacttgtaagatctcccacagccattgttatcacaaggtttctcttttgtgtgaattctcagatgtttactgaggtttgaattctgacagaaagctttcccacattcattacattcataaagtttgaatcccacataagttccaggatgctgaataggatgtgaacttgaacaaaaggattttgcacattcctcatattggtaagttttctctcctgagtggggcctctgatgctgaatgaggtgtgctttccggtaaaaggattttctgcatttcccatgttcatcagaaaggtagaatttatcttctgtgtgaattctctgatgtgctgtaaagtctaatttctggtagagggcatctgtacattcattatgttcaccaaatttatctccagcttgtgttttctgatgtactatatgggctgagctctggctaaaattttcttcacatttattgctttcaaaagcactccatcctgtaatagttctctgagattgagtgaggggtgacttcctactgaaattaatccccctttcattacactcatagtgtgtcatagccatgtgaactttattgtattcaacagcggtggttttgtcacaggatgtcccatattcattaagatcagagcatttcccccttgtgtcagttctcatgtggttaaataaagtgattttatcaaagttttttctaaattcatcatccttacaggacttttctcctgttagaaaactctgaggtgtaatacaaattgtcttatcatataaaccttgtccagatccatcacattcaaaagattcctccaaagtttgaaatttccaatgctgatctttcttataactgaaagctttagcattttcaccatgttcataagatttctcttcagcatgagctttctcatgcttaatatcaagctgcagtttctcacacacattcatgtattcagtcttctttcttgaatattttctttcacttataattaattgagaagcaactggcaaattcattctgtgtgagtcacatttacaggatattttttctgaaagctctggagctatttccagattaaatggtttttctaaaactttctgtccttctttactcaatgttttgtcagcatcactgatgaatatttcttgccacagaggtttttcttgtttttcccggatccctttgatgtgatcaactttaaaataccctaaaatgagaaaaattgaaaatatagtataaatcttacatttctcatggagaagaacttatactcatattttgattttggttttggtttttgaaatagggtattgctctgtcacccaggctggagtgcagtggcatgatcatagctcactgcagccttgaactcctaggctcaagtgatcctcccacttcagcctccctactagatgggactacagggatatgccaccatgtcctgttaattttttttatatttagtggagagagggtcttgctacattgcccaggctgatcttaaactcctgagctcaagcgatcctcctgccttgacctcccaaagtgctgggattgcaggcatgagccactgtgcccggcccctgttttgttatgtattttattctattgtttctggtcatgtttccaaatattaaatacttcatgcacacagacagactctctcctcatccatgctgtttataaaacaggtattatttccggggccagtcaaggtggagtagtaacccctttcctcccacatcttccctcttacaattaaaaatccctacagaaaaaacaaaacaacaaaaaaagattaacaaatatacaaatatacgaatactacaaaatggaaagaaagtggacttcaggacttaagaaatgacacagtatggaattccaaggctattctatatcctagactgggtgctgaagaaacctacaatcctgcactgacaggcacagacaaaaagagcacaaagaaaagcctgcttcttccagccagaggtctgagaaaatggtggtctaacagaacaggaaacacttttgatgttttctcatgctcaggccaaaccaaaatgatacaatcctgtggttccatggaggctgagcagggagctaatgttccctgccgtagatacacaggatctgcatgctcttatatgttttcttccatgagccatgaagaatcctgagaaagttccattcttaggatatgctgggagatggtcacagcagccactaccaaaattctgcctagaaccaaattattatctaatttatggaacaaatgtcttaatctgcaagggcaagaatataataagttgttttagggcactgacaggaactcatagcagctatgggaaggaaacaagaaaaaaagaagcacagaagtaagaggagaggcaggaatacacagtagacccaatactcaagcagaagagataagataaagtagcacttgcaataaccatggcttcaaacctgaagacacaatgcattcaacagctgaattcacattcttctgaaatgcacatggaacaatcatcaaaacagactatattctagactgtaagacaaaccttcagaaatatagaagaaataaattatacagaggatgatcttgggccacagagaaattataccagaaatcagtaaacacaaatttatctggagaaatacaaaagaactgtaagttacacattcctaattaacccatgggtgaaagaattctcaaatgagatattttgaagtgaatgtaaacaaaacaacttagaatacagaaatttgtggatacagctaaggcagtacacagagataaatttggggcttaaatttttttggccagacgcggtggctcacgcctgtaatcccatcactttgagaggctgaggtgtgtggatcacaaggtcaggagtttgagaccagcctgaccaacatggtgaaaccccttctctactaaaaatacaaaagttagccgagtgtggtggtgcacacctgtaatcccagctactcaggaggctggggcaggagaattgcttgaactcgggatgtggaggtgcagtgagccacggtactccagcctgggtgacagagtgagactctgtctttaaaaaaattatatttgaaaagaaagatctccagtcagatgcttgtttcccccttaggaaactagataaagacaggacattaagttgaaagaaagtagaaggatgacaaaaaagtcaaaccaaaagcttaattttttaaaaagtttttttaatgataaaaaccatcagagagaaaaaaagagaagacacaaattaccaataccaaaaattcaagagaggactaactactaacagacattcaagagataataaaacaacaataacaataactctgtcttagttcgggctactacaacaaattaccatagactaaatggcttaaagaataaacatttatttttcccagtgcaggagactggaagtctgagattagggtgccaacatgactgtgttcttgtgaagacctcttctggtttacagaccactcacttcttgttatatccttacatggtgaaaagtgaagtagctagctctgacaccgttttgtaacagcattctagtctctctcttttttttttttttaactataaaagcaaactaactttatttggacaatctaagtggaaagaagaggcaggtgaatgtgtattgtaaccacagagaatatattctatgtcaaatgttaaaacataatggcagaataatctaaaagactttttttctaaaggagctgtcagtgaaaaggatatttacgacaacatattaacttacttcattatgatggaggatatgttaactgaatgtctaatttactcaaattttaactatgtttgcatatgtaaataaggcttaagaatgtaatgaaatcttcctctatatatgtgtatgtgtgtgtgtgtgtgtgtgtgtgtgtgtgtgtgtgtgtgcaattccaaagaacaacttctggaccaaatagttttaactagtaaattttaccaaacatccaaggaagaaataataccaatcctacacaatgtcttctagaaaataaaagatggaatatttcccaaatcattttataaggcctgcctcatcctcatagcaagattaggcaaatactattcaagaaaagaagctttcagaccaatatctcccataacataaatgcaaaaatgtcccaaaaagtacactgaaatatataaacatagataatgtatcagtgaaatttacctcaaaaatgccaaacagttactacactgcaatactataaaaactatagtttttatgctgcatttcaggtcaatgtaatctcctatcattagtctgaagaactaaaatcacacactacatcaatgccaaaaattttaacaaaattcaaaatccatttattaatttaataaaagtaatctataaaaagcctataactaacattatactcaagagagactgaatgtcttccctctaagatcaggaaaaagacaaagatgcccactaccagtagctttacacaagattgcactggaaggaccagccagtgcaaaaaggtaagaataaaaacacaaagatacagagtaaatttacacagaaagtttaaaatcaaaaaagttccttgaactaataagtgtttttagcaagggcagaatctaaggccaatatacaaatctatgcctacaaacatacaatgatgaattggaattttaaatcacagaaacaatattacagcaccaaaacaaaattaaaaacaaaaattaaaaaagcctcgttatctgtgttctaaaaactaaaagacattgatgaaagaaatcaaagaaacagtaaataaatcagtagggatattttgtgtatggactggaagactgtacgttgttaagatgtcaattctcctaagttctacagattcaatgccactccagtttaaatgccaacatgtttcctttgtaaagattatgaacctcatttaaaaatttatacacaagatgaaaactggagaagtacttgacttcaaaacttaataagctagagtaatcaagttaatgtggtattggcataaggaaagacatgtagatgaatgaaaaggaatattaaactacaaaaatagacccccaaatgtacagccatctgttttctaagaaaggtggaaatgctgttcagtggagaagtaacagtcttttcaaaaagtgatgctggaataactggactccctgttccaaaaacatttaacttgacacataactcatactttctatagaatttaacacaaaatggattatcaactaagtgtaaaaactgaagctgtaaaatttctagaagaaaataggattcctaaatctgttactttgagtttcaaggtttctagatagaacaacaaaagcaggttctgtaaaagaaaactagtaagttggactttatcaaaattaatattcagttttagtgagcctcctctgaagttatactagcgggagtgaggtgcagcatcactgcctgctacgtggggaaggaagtccagttccccactgatctgaccccctgggggtggaagaggaggcttctacttttttttttttttccttccttttgagacagtttctctcgtcacccaggctggaatggagtggcgcaatcttggctcactgcaacctctgcctcccgagttcaagcgattctcctgcctcagcctcctgagtacctgggattacaggcacctgccaccacgcctggctaatttttgtacttttggtagagatggggttttgcaacgttggtcaggctggtcttgaattcctgacctcaggtgatccacccgcctcggcctcccaaaatgctaggattacaggtgtgagccaccgtgcctagctgaggcttctacattaaccctgggcatgggtgaaagatcaggagccccacaaggactctgataacactaaccaccttgtattttgtcaggtgccaagacccctagtgcatcttcattcttctttccacccttcagtagtgtgatctcagctcaccataacctccacctcccagattcaagcaattctcgtgcctcagcctcccaagcagctgggattacaggcacgagccaccatgattggctaatttttttgtatttttagtagagacagggttttgccatgttggctaggctcgttaaactcctggcctcaagtggtctgcctgcctcggcctcccaaggttctgagattacaagtgtgagccactgtgcctggctagatattgcattctttacaaactgaaggtttgtggcaaccctgagttgggcaagtctgttggtgccatttttccaacagcaagtgctcactttgtgtttgactcagcagtttttagcaaacaaatattttaattaaggcatgcatactgttttttagacatgttattgcacatctaaaagactaaagtatagtgtaaacataaaacttttataagccctaggaaaacaaacattgtgtgtaacttgctttattgtgaaatttgcttcattgtagtggtctggaacagaaactgcaatatctctgaggcatgcttctatatacagatatttagctgcacttagtgggtagagtagaaaggaatacatttactccatccttcccctgggtaatgcattctgtattttattaaatccttccctaagaagagtcattaacctattctatatgatcttctagaatatttctacttttgttttgataattaggtcttaagccaactgaattcgactttttgttttgttttgatctatatggatacctcaagatcctttcctcattgttctccagtgtcatctatctaagatgtctatcaagtatatgttttttcttttgtcttttttttttttttttttgagatggggtcttgctctgtcgcccaggctggagtgcagtggtgcaatctcggctcaatgcaagctctgcctcctgggttcacgccattctcctgcctcagcttcccaagtagctgggactacaggcacctgccatcacgcctggctgatttttttgtattttcagtagagacgggtctccatctcctgaccttgtgatccacccaccttggcctcccaaagtgctgggattacaggcatgagccaccacgcctggcctcatgtttttttctttaactttctactctgtttcactaatttactaaatcatcccaccccccagctccatgctacttagctacacagcactttacataaagcctcaatatctggtagagcagcaaatcctcctgtatcactcgtttttatgaatgggattgtgtttggtatagcgttatctctttacagatgtatcctgacttgaatttattatataggtgtttcctctcttttttctttgatagggttagctgaagtttaattcattttatttttcttgtaagaaacattccatttctgttttccattttatttttaattttacttttaaattcttctgttttcactattgtatttttgatgctgttcttgcttaattaatgagactacgaacttccttctgtccactactttagctatacctgatggtttctaacttgcagttacaattatttcattacagaaatcaaatccaaaattgcattacacttttttgtatattgtttaaaagagatactaaaattttttcaagtggatttttttcattttattattaatttctggatttaccaaactaggttcagagaatactgtttgtgtttattctaatttgttagatttattgaggttttctctttagactaatagtatactctattttatcattattcaattaaaacatgaaagttttgttttttgcattagcatacatatacacaaatgtatggttcactttaatacaaatgtaatttatagcctctctaggcatatttatttaatgtccactgtacctactgtttaatcagatgagacattatgatgtcctaattctaatgagttttaagttcttagaactccattattttatgttttagaaacattgatattatattatttggtgcagtcattcaaatccttaaaggttttcatttccctgtgctcttgaatgagagcttttcctactttaatgaatttcttgcctgaattcaaatctgaatgatatagaacatgaaatctacattattttatctttattgactcaacaactttactgattttttttttttttttaattttttgggactgagtctcgctcttttgcccaggccggagtgcagtggtgctatctcggctcactgcaagctctgcctcctgggttcacgccattctcctgcctcagcctcccaagtagctgagactacaggtgcctggctaattttctgtatttttagtagagacagggtttcaccgtgttagccaggatggtctccatctcctgacctcgtgatctgtctgccttggcctcccaaagtgctgggattacaggcatgagccaccacgcctggcccaactttactgatcttttataatgatctttctatgttacttatttagggatatcctttttagacaatcaatatgatccaataatttacatttagtgactcagcaacatacttgatctaaattatgtcactctttatgtgatgctatttgttggtatggcttcaaacaaaaaccttaattgtgcttcacttctaataagatgattttacttttttattctaaaaatgacattgaaaactataactttttaagatttctggaatcatttattcgtacaaagcctaataggcatataaaaagatgcctgatatcattggtgaccagggaaattgttatagacttatttgtgtccttcccaaattcttatcttgaagccctaacccccagtgtaactgtatttgcagacaaggccttcaaggaggcaaaaagggtaaaaatgaggtcacagggaaggaccctaatccagtagtactgatatctttataagaagcggaagaaacaccagagtattctctctctcccactgcatgtgcacagaggaaaggccacatgaacacacagcaagaaagtggctgtcttcaagccaggaagagacgcttcaccagaaaccaacttattagtactttcattttagactcccagcctccagaatcatgagaatttctgttgtttaaactacccagcctatggtattttattatgatagccctagctgactaatacagaaatgtacatcaaaaccacagtgagatatcacttcacatccactggggtggctagaatcaaaaagtcaaacaataacaagcactggtgaggatgtggagaaatcagaacccccatatgctgttgttaggaacggaaaaatgctgcatttagaaaaacagtctggtggttcctcaaacagataaagacacagataccatatgacccagcagtttcactcctaggaatatacacaagagaaataaaaccaattgtccatgcagaaacctgtaaataaatgtttatattagcattatttgtaggtggaatcccaaatatctactgactgataaatggacaaacaggtggtacatccatacaacgggacattatttggccataaaaagaatgaaacatgtattttatatcagttgtaaacattatgctaggcaaaataaaccaatcacaaaagaccacatatatgatccaatttatacaaaatgtctaaaataggcatatttatagacacagaagtagactgtggttacctagggctgcagagggcaggggggatgggacagtgataactaaagggtacaggtatgtttgaggtgatgaaaattaactgtggtgatgtctgcatatacagtcatcccctggtatccatggggaattggttccaggattctcttaaataccaaaatccacaaatgcccaagtccttgatacaaaatggcatagtatttgcatataacctatgcacatcctcttgtatactttaaatcatcaccatattaattatgctacctaatacaatgtaaatgccatgtacatagttgttatactatattgttcagggaatagtgacaggaaaaaaatgtctatacatgttgaatgaaagtgcaatatttcttccctgaatagttttgatctgtggttgcttgaagtcactgacctgtacactttaaaggagtgaattgtaggcatgtgaattatatctcaataaagctgttccaaaaaaactttcaaaggtgctctccctctaaagactaagtacccccagggggctccttctgttaatgcccactcacctgggtacctctggttcaggaattcatcttctaaagaccatggctcttctcctttctccaacttggagatcaccttaggtttagtaatgcaatatcctgtaaacaaaataattgacatggaccagattcacaggcttttggatttccaaagggaaaaaaagatatggcagcaaagcattaactgagggtgttcatttgaaatttttaatgggaaagtaatgacatgttgcttttgtttctgtaaaggtttcaactacttcaaaccttttaatccaaagccctttaatctctataaagggtccatgtgttttgatactttttaaaaagggacatatattctcgagagagccccatggtaagctatgctcacccactgagatgaggtggctgtagttctccagcatcacatctctgtacagcgtcctctcgacagggcccaggtgctgccactcctcccgggtgaattccacagtcacgtcctggaatgacactgatgcctgtaacaacatttatcacaacaaatataacaatggtttgttcaagggttcagaattgggtgacacagaaaatatctttgagagctactactaaaatgaatggttataaaggcctattttagacccaaaattgtcttaacatatgtaactcaaaacattttttaacttgccataatttctctatgtatttatgaattctaggtttttgtaagacaaaaaaaaatcaatgtaaaacaacttccttccaaccacctccttccttcttccacatctccgcaaattatccggggtagtctctaggacattcacaccctccctggacatcatcactgtaaattctgggggctaaggaagagatatatgtgaagtctggagataccctgaccaaactttatatagggtagagcaggtgaagagcagagaacagctataatagttgtaaccaaagagactggcacaaaagaacacttcctacactgaggtcacagcaatggatgtaagaatagggatataatcacagaagagaagcaacacccatttaatacaatactttcttgtacagctactcaatctagctgtatgagaagctccttttaaaaaaattttgtttttaattgacagaaagacaaatatttcaaattatagtcacttatatgtggaacctaaaaagttcaaactcatagatgtagacagtagaatggtggttaccagaggctgggggtgaggggtgaggaatggggaagcattggtccaagggcacagagtttcagttacataagaggaatagtttttgagctattgcacaggatgatgactagaatgaaaaataaagtaatgtatatttcaaaataagcagctgcttggtggtgccaaaactggtatctgggaaagaagaaaacgtgttagaagattcagtgagagttctgttcatgttgatacgtagctagaactgttcgttcaaccaggatacatatgattttagagcacagaaggtaagatggggatgaagataagcatttaggagttactagcaatttaggtggtgagtaaaattagcagagacagacagctccttgagcacacagggattgaagaaagaaaagaaccaaaaacaacacctgaggaaccacaaagcagaaaaagtacaggccacaaagccagagatgttttccaaaaaataataacagaatcaggagggggcagagtcttagaaattgagaaaagagaaagtttccacaacaagaagacttcaaattcaaattagcaagtgatgacggtgaagatactgaagatccaagaaaattccttcttccataaaagcaatgagaaaccggcaaaaactgcagaatcaactttttcagaactctagaagctaccaaaggcttacagcaatctgcggaacattgatatgagaaaaacagctgcatcacagtaagaacaatgatcttgtgtcatttcaacctgccctatatccatccctctcactcccactcggcattagctttgagaaacatctgaaacaacaggagaatccagcggcctggtatccactggatgaggcagactgggtcacaggttggccaaagcctcactcccagaaaatcctcattatctgacctaatctgtggttccctggaagagctgacttgaaaggctgattgaattaagtcagagttccccagtgtgaaaagccttattcttgaaggcatttgccaaaaacattcaaaggcaattgtttaactcagcagctaactgaggcggtggataacacctgacataaataacagcctaattgaaaagctttttagaaaggaaaaactggagaatgggatgttcataaagcttttgaaaagctcctatagattctagagactctaggtcacctacatgcatagagctgagcatatgcccagggctgtgattatgctctggaaagatgtgagaaggccctaaactgtcaccctgggtgaccctaaggtttggggtgaactggaagtgaaggaagtgaaggttaacatggggttataaattgcctggatgtctgttgaaggaatgccccagcactcatgaggctctttggcaaagactgagagccttacttaaggtttcaggcatttaagaaaatttctgcagacttctgcagccacacatgacaataaacacaggctctactgaatcaattaaaaagtcactagacaaatttcaacaacaactcctgcaaatcaagaaagttttctagagttgccaccttatttaaaatgtatagttttcaacaaaaaatgcaaaacaagaaaagaaacaacaagtaagacccatatgcaggaaaaaagtacaatcaatagaaactactcacgaggaagcaggcattggacttaaacagacgatgactttaaatcaactatgttacatatggtcaaagacttagaggaaatgatatgtaaggaccaaaggaaagtattagaataatatctcaccagataaaggatataaataaacagaaactataaaaagggaccaaatagaaactttaaagttggaaagtacaaaactaaaacaaatattttaccaaaaacacctgttcaacagcaggtctgaacgggtagaatgaagcaactggacaacatgcccactgagattatgcagtgagaaacagaaggaaaaataacaagaaatgaacagttggacagcatcaagcttatcaacatatgccaaatagactaacagaatagagacagaaagggtctaaaacaatatcagaagtagtaatggccaaaaaaccccacaaatctgaaataaatgataaatctacatgcccaaaatgcttcacaaactttaagtaggataaacttggagaaagaaatccacactcgctgggagcagtggctcacacctgtaatctcaacactttaggaggtaggcagatcacttgaggccaagagttcaagaccagcctggccaacatggtaaaaccccatctctactaaaaatactaaaattagccagacatggtggtgaatgtctggaatcccagctacttaggaggctgaggcacaaggattgcttgaacccggaaggtggaggttacagtgagccgagatcatgccactgcactccagcctgggtgacagagcgagagactgtctcaaaaaaaaaaaaaaaaaaaaaaaaagaaaagaaaaagagaaaagaaaaaagaaaagataaatccacacctggacatgagaatcagagtgttaaaaagacagacaatcggaaagctgtaacagagaaacaagtcatcatattacaggctgatttataatgagaaactatggaggacagagggcaatgggatgacatattcaaagtgctgaaacaaagactgtcaaccaataacctctatatccaggaaaaatagagaaactggaattttcccaggtaaacaaaacctgagataattcatcacaggcaagactgcctataagaaataataaagggaatggttcagcaaaactatggagatagaggagtaggttagtggttgtttggggctcagagggaatcaagtggtagttacagtgtacacagcttctttctaagggaataaaaatgttctaaaattgactgcagtgatattagtacattatctgagaatgtactaaaaaaatcactgaattctacactttaaatgggtacatggtaagatacatgaattgaatctcaaaaaaagcagttttaaaaaaagaaaaaaacaagggaagacaaaatcatttggagacaacagagaagactaaagagccaaggacagaaactgaggctgagccgagtgacaggacaaggaaggtggctccatgaagacatcagccggggaaggaccagtgaggggcaagtatcactaacggaaatgttccaggacagagtgagacattgaggcaagtgctgcggaaaagccaagcaagttaaggaaaagaccacatccactggatttgattatactatgggtagggacactggaggtcccaggcaagtggcaagaaaaaatcaaggcatcccatggagagttgacgttaaatgctaagtgtggaaatatctgaaagagaacaattttggaccatctgctgagcaacctgaatatcatgggtactcaaaatatttatggagagtgattttaaagacattcagttgattcatcagaaaaatgttaaattcaacccttgcactggagtacttgaaaaatagtactgaacgtgttcaaatttagcattacaatttctacttctattgaggaagtaatattctgttatttggcaatttattaactaagtcacctacttgaagaacaataaatacattttgttatctttatgtttatattccatgataaatcagttggctttatctttctcatcaatgtaaacctttaagtattgtctgtctgacactccaccatgactgtcaataacctcagaaataaatctgaagcttaatttggtaaatttgtaatatcggaggatctgcatctatccacatgccactttgctctgctattcatctgcatttctacatcttctaggaatgtgtctgatccatctctatttctacttttccatgttaatgtacggacacataaacccttacaaaacctattgtaaaataaaccggtttttaaaaacctaactcacctgagacatgttcattttctgctgctcctggaagagtgtagaggactgtggaggttcagctggggaggaggaaagagcagtggggtcatgagagacctggtctgcctctcagttcttacagagatggtccctgacatgagatggttcgacttgataatggttttactgcgacataaccccactgtaatcaaggagcatgtaatcctattcatgtgcctaaaaaaaaaaatcatcgcactcagctggagaaaaggattcccaatgcagaatgtccctttgactcttgaaaagggacaagaaggaccactcaaagatagccacacctgaatatgtgcatctctgatacgattatgtgcgcttaaacttacattttcactgagtaaagtaatactgttttttgttgatttactaataattatgttgatttattaacaattatgttcccttttgactaagaaaaaagtaaaaataaaacaaaggattaagcaagttcaggtacacagagatgaagctgtttaccttcattaaagctaatgtcaaagaactactcagccgggcatggtggatcatgcctgtaatcccagcagtttgggaggccgaggggggtgaactgctggaggccaagagttcaagaccagcctggtcaacatggcgaaatcctgtctctactaaaaatagaaaaaaataaaaaataaataaatttaaaaataattttttttaaaaaagaactactcaggctgacttaatcaagttcttactgcctttacacccagaattagcacttccacggaaaaaataaagatgggatgttttatgcaaggaatttcaggcccaatatttttgggcttccaatataggaaattcttcctctactacccggaaagaggcagcattagtatcactctaaatgccacatgtggtgatgaacacggtgtgagagggactcacaatgtggaagaagtgaaggcagaaaggaaactaggctgccgtttgggatctggacagctgattacatcttccctggatatcatgacctaaccagccctccagtaaagtgtctttttccacccagcttgatagtcactcatccctctcaacccctgggaattgccttctgcaagttagtccacagcaaagtcacacggtctgtgatggcttctggatgtggcaacatcacaaaatctgatgcatatatagggagtcaacaactgcctctggggaagcaatcaggacctgctcctttctagaatcttctgcctctgctctgacgctctagaagaggtctcggtcatatgggctgttcttctatggcagtagtccctaggactccctcttgactgcctcataggagctgctttgctccagaggggctgggacttaggcctgagaaacaaactcaattgaaaccttcacctaataccctaaacctgactcttgagattcactagaaatgtgctatccagcactgcagccatcagccacatagaaccattgaacacctgaagtttggccagtgctacaagtcgaatatttaggaaggaatgagttaagtaaaataaagcagtaaaactgactttgcctgcctcttctttttactgtagctactgaaaaattctaaacttttttttcttttttgagacagagtctcactctgtcactcaggctggagtgcagtggtgcaatcttggctcactgcagcgtccgcctcgggttcgagcgattctcctgcctcagcctcccaagtagctgggattacaggagtgcaccaccacgcccggctaatttttttatttttgtagagatgggcttttgccatgatggccaggctggtctcgaactcctggcctcaagtgatccactggcctaggcctcccaaagtgctgggattacaggcatgagccaccgcacctggccaaaaattctgatttatatttgtgttttgccttatctttctattggacagcacagcaccagaatatcaatctgtgcctttgaggagacagcgggaacagtacaagaggattcaggagcctcagcctgaatcagagacccgacaaatcgcagaatgtatctaccacttggtgagattctgtccacatttacttcacaatcatctacacagatctggtgacaggccactctgcataagcgctctgaaggctttaggcaggtactggcaagtctgggtttcaggcagacagcatgttagaacgagcaggacagggagtcacatctctcagcatttgcatctcacctactagtgtgtgccctggggtacccatccccatgaactttcgtccatttttttaaaatggaacgtttataccaaagaggtcgttgtgagggtcaggtgaaataccaaacgatgagaataagtgtctcataattgtgagagcagcttacatttcacatagtgactattacagacacttaacaaaatgctttacaggtgacaacttatttaattttcagaataggaacacgagttactagtaacctcctcctgttcgccgtcaacctcatccacgcacatttcctcttcccggcccgcaaccccgcggggcccggcagcccctacacctgcggacaggactcggcctgggcccgcgcactgggccggggaggagaggggagggccatcctggggactcctgagactgcctgctgctgtcctccgcacacaagcccgcccgtccccaggttcctgggccgcgcggagccctgtcaccgacgctctcaccccaggtgcgcagcctcggctcccgcgcagacctaaagactcggacaccgtgtccctttcaggcccgggagggcagacggcaggaggtggggctgggtttacacatgcgcagagcgagccccgaaaccccattcccaaagtgctgcgcggtaggcgcgttaacattgaaaactacagtaactacagttcccgtaagcccgtgcgtccgaaggaagtactataattttttctgctgctttgaccggctgggagggaccttcggagcccagggatttcccaaattcccggaggttgtcagcatgaccacaaactgcgaagtgtggttcttgatgcgatcctggttggagaaaaaagcaccttaaacagacattaacaattggggaaacatgactatcgacaggacattagaaatattaaagaaaattaccgttactttgagaataatagctagacgatgtaggacattgttcttatatttaaaagatatgtacagaaacatttacaattgtatgcttgtagtttaattgaaatacttcaaaaatttctcaaaacaatgaaagcagatatagtaataagtgaagaattgttaaatctgtataatacgtgcttatgatgctcattttactattttctaccattctgagggtctgattttttttttttcatactcagtaaaagacgtgtggggcagtgcagtgcagggggagtggagaggctttactatcccttcggaagtatgccgttaaattcaaagttgccaagggaagtaaaagtacataaaaatagctttatgaataaggttgtgaaatcgaacaaatactagaaaacataaacgagtaacatctgtgatcagcagggtttatgggggttggaggaggaagctagctgttcaaaatacatatgtgatgcgtgaaaacacatgcaacccaaaatatgaaaatgattattacaccaaccttgcattttcatgaggaaaccttttttgaaacgtgtatacccatctgactgtttaaagaattaggaatagataggtactataactttttttttaattaatagacttttcttattttattttattttattttatttttttgagatgggttttgctctgccgcccaggctggagtgcagtggcgctgtctcggcccactgcaacctccgtctccgggctcaagctactctcccacttcagcctcctgagtagctgagactgcaggtgtgggccaccatgcctggctaattttttttttttctttcgagacggattttcactcttgttgcccaggctgcagtgcaattctcggctcaccacaacctccgccccctgggttcaaacgattctcctgcctcagcctcccaagtagctgggattacaggcatgtgccaccacgcccagataattttttgcatttttagtagagacagggtttcaccatgttggccaagctggtctcaaactcctgacctcacgtaatccaccttgcctcggcctcccaaagtgctgggattacagacgtgggccactgtgcctggccttttgtattttttttttgtagagatggggtttcactatgttgcccaggctggtctcaaactactggggtcaagcgatctgtccacctcagcctcccaaagtgctgggatattaatagatgtacagagcagttttaggtatacagaaatattgagcagaaagcacagagttcccatatacctccgctcatcaacccacacacagtttcccctattattaatatattgcattagtttagtacatttaaaatacatagtttatattagctttcattctgtctgttctacagttctgagttttgccaaatgcatgtcttttagtgcgatttccaccaatgcaatgatgtaatatccaccattacagtatcataaaaaatagtttcactgcctgatatggtttggatttgtgtccccacccaaatctcatgtcaaattaaaggaggggcctgatgggaggcgattggatcatggaacagatttcccccttgctgttctggtgatagtgggttctcacaagatctgatggtttaaaagtgtgtggcacttcccccttcgttctctcttttgctttgccatggtaaagatgtgattgcttccccttcactttctggcatgattgttagtttcctgaggcctcccagtcatgcttcctggtaagcctgcagaactatgagtcaattaaacctcttttcatcataaattaccccatctcaggtagctgtttatagcagtgtgagaatggattaatacagaatttggaaccaggagtggggtactgctatgaagatacctgaaaatgtggaagcaactttggagcataactttttttatttcacattgtgccagcaacatttgtagaaaaggctatcttttctccactgtattgtctttgttcttttgtcaaagatcagttgctgatacttgtgtaggtctttttctgggttctctattttgttccattgatctattaatacttgtcagttatttcaccaacatgacactgccttgatcactgtagctttatagtaatttttgaagccaggtggtattagtcttctgactttttcttcaatattgagttgactatctgggtcttttgcatttccatataaactttagaatcagttttttgatgtctacaaaataacttgctgatattttattgagattgtgttgaatctattgatcaagttggtaggaactaacatcttaacaatattgaatcttcctatccattaacatggaatatctctccatttatttagttatttctttctttcatctgagttttgtacttttcctcatatagatcttgcatgcatattgttagatttatacctaagtatttcattgttttaatgataatataaattgtgtgtttcaaatttcaaattccaattttcattgttggcttataggaatgtaattgacttttgtataataagcttgtatgctgcaatcttgctaataatcacttagttccagatgtttgtctgtcaactctggggtttcctacagggacaatcatatcatttgcaaacaaagatagttttatttcttccttccctatctgtaggctttttacttcattttcgtgttttgttccattagctaggactttcagtatgatgttgaataggtgtggtgagaggggacatccttcccttgattactatcttaggggcattttctttctcagcatttaactatgatgtcagctatgagttttctgtaaatgttctttatcaagttgaggagcttccctctattccttgtttgctgagagtatttatcataaatggggattggattttgtcaaatgcattttctgcgtttattgatatgattgtatgatttttttctttaaccagttgacaagatggattagattaatttattttctttttcctttttttttttttgagatggagtctcattctgttacccaggctggagtacagtggcgtgatcttggctcactgcaacctctgccttccgggttcaagtgattcgcctgcctcagcctcctgagtagctgggactacagatgcacaccaccatgcccagctaatttttgtatttttagtagagacgggatttcaccatgttggtcaggctggtctcaaactcctgacctcgtgatctgcctgccttggcctcccaaagtgctgggattacaggtgtgagccaccatgcccaggccagattaattgattttctatgttgaaacagctgtgcatacatacctgagataaatccaaattatggtatataattccttttaaatattgttgaattctatttgctaatattttgttgagggattttgcttccatattcatgagaaacattggtctatggttttcttatcttttaatatctttgtctgattttagtcttaggccactgctggcttatagaattagttagaaagcatcccctctattttactgaaaagattgtagagaatttctgtcttaatgtttggcagaattcaccagtgaaactatattggcttggagctttttataaaaagttattaattattaattccatttctttaatagatataggcctactgaagtagtctatttcttatttgtgtgagttttggtatatttgtcttctaaggaattggtccatttcatctatgttatagaatttgtgggcacagagttgttcattggatgtgaaattctaagttgacaaatttttttctgtcaacactaaaaattttttttttttttttgagacagaatcttgctctgtcgcccaggctggagtgcagtggcatgatcttggctcactgcaacctccacctcccgggttcacaccattctcctgcctcagcctcccgagtagctggaactacaggcatccgccaccatgcctggctaatttttttttgtatttttagtagagacggggtttcactgtgttagccaggatggtctcaatcccctgacctcatgatccacccaccttggcctcccaaagtgctgggactacaggcgtgagccacagccaacactaaatatttcactccactgtcactcgcctgctttctgaagagaagtctgatgtggttgttactctgtttcacaacatgtaacatcccctcccccgacccacctcctttcaagattttctctttgttttttatttttctacagtttgaatatgatatgtttaggtgtatgttatctgatatttatcctgataagtgttctcttagtttcctggtctatagtttggtgcctgttattaattttcaaaaattatcagccattattacttcaactatttcttatcttcatttttcctctctttttggtattcccattatatgtatgttacttttgtaattatctcaccttcttggatattctgttctgtttttaaaaaatcttttatctctttgcatttaacgtttggcagtatatattgacatatctttgagctcacagagtctttctcagttatatgccatctactgatgagcacatgaaagcagtcttcatttttgtttcatcgtttttgaattgtaacatttacttttgaatctttcttagagcttacatctccctgtttacattatccatcagttcttgcatggtatttgctttttccattatagcccttagcatattaatcagagtcattttacatttcaagtctggtaattccaaaacctctgccaattctgagtccagttctgatgcttgctttgtttcttcagattgtgttatttttgccttttaatgcactgcaatttttattggaagccgaatactatgtatcagataaaaggaactgcagtagatagatctttaatgtaaagtttaatgtttatctggctaagagttaaactgtgtttcctgtttgtggtagctgtgatgtcaaaagcaaaagtttcctctagtgtccttgtttctgtctcccatcttgtctttgggtgttcatagactccagaaatagggtctgagcctgcagttcttttaactgtaattccaggctatcatgcaggagctctactgatgcagtagtaatgagtgtgaggagggcaagccttctataatcctctgattagatcccagtcttttagtgaactgaagttatgtatttcttttcctccgtgttaaagtctgaagggggctgggattggggattgccttccccaggtcacttaggttttcataaaaatcctttaggctgggttctggtaaagtagttcccctgagtgtgggccttgttaaggggagcagagagctctgagcacgtctcaaaaatggttacttttcccctccaccctgagaaaaatcatcaaaggaattttctctgatctccatactgagaacctggtagggatcttgcaagtaaaactctgcgaagtgttggggctgcctccaagaccaggtttcttctgagttcttaactctaaatttagtccacattgagcctctagcaatttacgaattacagtttaaaatgttgctacccatactgctgtggacatctccctctgggaatctgctcctggtaagctgtgattctctgtatctgcctgtctgtttctccagttgtcctgataacagtttgtcccatgatctcaattctctactcgagctaagaagagttgttagttttcagtttgttcaaccttattcttgcggaagataagaataatgacttccaaactccttgcatgtcagaccagaaaccaaagtctgtttattgtgttttgaattgcattgctttatgctgtaagaacaggtctttgtgaagttcagtgagacttgcttccaggcttctactttattccatgaagtatcttatcaaagaatttaagctaattgagtctgtgaccatccatagtagcactactcacctctgttattatctttcttttttctcatagttctctcactacacaaagtatcctaagtatgttgactacaacaaaatggcaacttcctgaggacagggagcttgtctttgtctcactgagcatatatgtgctcaaatatttcttgagaaaggaacaaggacctaaatctgctagatactaccaggcagtggatttctggtaattaacaagacattacctaccttcccctagcttagcatctagaggtggagatgataaggactatgatgagagacaacagagcagaagacaaggacaggaattctcgtagttggcaggggcttctctgaagaggtaacactgacactcacgctcaaaaggtgggagggaagagatcatgtgcagaatagaatggagggtaagcccccacttaggaaaaccagcgctcactatgggaaagattttatcccatttgaggaagacataaaagtcaagtgcagacacttgaagccattaagaatgttcctttggctttactctgagaagtgcctaccacaagccaggctagcaaacaccttctcttttgtctgagctagactgtcaagcaaacctcagtgatgaagaaggcaaagtgatatgggtcctttcctttttttaaagtaattatttcttattcaaatcaagaagttaatttgtgaaaatgtccgtcactcccaggccaactagaccaagacaagagtaatcagagcaatggagagtgcgactgagagagaataagaatgactatccctttacacacccaccagaatggctgcttacgagtctggctggctagaataactattttctttttctttctatttttttgagacagtctcgctctgttgcccgggctggagtgcagtggcatgatcttggctcactgcaagctccacatcctgggttcacaccattctcctgcctcagcctcccaagtagctgggactacaggcacccgccaccatgcccggctaattttttgtatttttagtagagacggggtttcaccgtgttagccaggatggtctcgatctcctgacctcgtgatccacctgcctcggtctcccaaagtgctgggattacaggcgtgagccaccgcgccgggcctagaataactattttcttgttattctgaagctactttgggttcttttctcagttcacaaatattacacacatttttcaaatagcagagattcttaaatattctgaatttgaagccatatcacccgacgctcattcaaactgcatgaaactgattatcattaaaaaatcatgactattattaaaagtgatgcagtacaaactgttttagggtaacagagttaaagaggaaaaggccttctttgtaggaaaaaatagagttaataatttcacaaggattaaaagactatcaccaccgtgcaacctgaaataatggttgtaggcaatattcatcagcggctgctaaatccattcatgatagcttagtaagaatttcttgagataaaataacataaaatttatcattaactaaagtttatcattttaaccatttttaagtgtacagttcagtggaattaagaatattcacatggatgtgcaaccatccccaccatccatctccaaaattttttcatcttccctaattgaaaatctgtacccattaaaaaccataacttcctcttccttccccccccaccccctgacaaccacctaatttctgtatctatgggtgtgattactttagataccccatataagtgaaatcatacaatatctgtcctttatgactggattatttcattcccttagcataatgtcttcagagttcactcatgttatagcaactatcagaatttcattctattttaaggctgaatatgcaccattgcatgtatataccatatttcatttatctattcatccattaatggacacttgggttacttccacgtgctagctgttgtgaataatgctgttaggaacacgagaatataaatatctgttcaagtccctgctttcaatttctttagatatattcccacaagtgccatttctgggtcatatggtaattctctgtttaatttttgagaagctgctacgctgtttcccacagcagctatagcattccagcaatgtgcaagcattcaaatttttcttcatcctgaccaacacttgtttttttttttttaaataataaccattctaatcagtgtgaagtcgtatctcgcgattttgatttgtatttccctcatgactggtgatgttggctatcttttcatgtgtctgtaagccatttgtatatcttctttggggaaatgtctctattcatgtcctttgcacatcttcaagctagattgtttctttttgttgtcacattgtaggaattatttatatattctagatattaatcccttatcagatatgtgattagcaaacattttctcccagtctgtgtattaccttttcactctactgagactgttttgatgcacaaaagttactaattttgataaattccaatgtatctatttttcttttgctgcctgtacattttatgtcagatctagaaaaccattgccaaatccagtgttgtgaagagtttcctccattgtgttctaaagttgcagagttttagcacttaacgtttaggtctctgatccattttgagttaatttttgtatatggtgtaaggtaagggtcagctcattcatttgcatatagatatctacttttccagcaccattttgctgcttctaggataggtagattcattttaaaaaatcaagtttggaaagtttcagtcattttctttccctcctttttttctcagtatgcatacattagtatgtctgatgatgcctcacaggtctctcaagctctgttcattattgtttattcttttttctttctgtttctccaactgaagaatttcaaatgacttatcttcaagattgttaattctaccttctgcctgctcaaatgtattgttgaaagcctctggtgaccttttcatcttgcatattgtacatttcatttcctaaatttttattttgttccttttatgtttccacttccctgatgatattttctagtttttatacattgcattctgctttccttttgttacttttccatggtttcctttaagatctttgagcatctataggacatttgatttaaagtttttgtctataaagttcaatgtctgttcttgctcaaggatactttctcttttctcttttcctgtaaattagccatttttttcttatgtctttgcatgacttagaatattttgttgaaaactggacattttaaatgttataatgtggtcactctgaaaatatgtttttctcttttaaagttctgttactgttgttcaccatggtttgtagttgcttatttgtatactgacttttataaaccagttttttaaagactgtattctttgtttttcatggcacctgctatggtatatgtcttccctcaaaattcctatgttggaatcctaaccgccaaggtaatggtgtgaagaggtgaggccttgggaaatgattagatcttgagagctgatactccgtgattgggattaatgtccttataaaagaaacttcagagagttgagtagccccttccatcatgtagggacacggtgagaaggcactgtctatgaaagggcaggctggcaccttgatcttggactttctaacctccagaactgtaagaaataaatttctgctgtttattaactacccagtttattgtattttgttacagaagcccaaatggactaagatagcctctgaagtttttgttcctttatcttgtggtcagctagtggcttgacagagatttccttaaacacatgtttcagttgcctctgttttggcgtagcatttgctcagttgctgtaaactgtgactatttttcagagttctgagaaagttgattctgacagattttgctctgtttttgtgtgtgtgtttctgtggaggatgagccctgatgctttctaccttaccattttccctggcatcactcaacagctctaagagctttcaagttttgacaattcttacaggatatctttccagtgtttgttctctgatgtctaatattggagagccatctctttttcttaaatattgataacacaaggccagtgaattcatactcaggttatgagggcctgcagtgcatacttacagggcagttttcttgaagaaaatatatttatgcccggatctcatagtttcctagaaacatacttttgctctttacggagcaagtatactccccaaagttgtgaataaaactgaaataaatggtttttttaattctttactcttttctaagatgttatcaagttgatggtcctctaaaaatgataaaaaataaggtctcttaatcctttcttataaaataaaacttatatacacaagccttattacagattagatattttggtttctggcatattatccacagaataaagtgattccaagtgtatattttctatattttcttcatttggaaaagaaatatgttcagaaaaattctctttgggaaactggcattgaatgtacacaggtattttggcattttaaaatgtgatttttcaaaactcagtggaaagagaaataaagggaagaaatagtgaatagagaacaatagtctttaagattaattctaggaatggaaaatcagataacatagtgaactaaacaagacatgtgaagagtaagtagaataaaaagaaaaatcagtgcacaaaaattgtcaggactttatcagagacagggtttagattagagagggataacagggtccagattctccaactgtcaagtataaattacattggtaggatactcattagtccatatacttccggttggacttctcccttttccattccactcatcatgaaaataaatttaggatgtcaaaagttacctatatttaaagaacagacttataacccaagctgtaatatccctatcacatcacagacataaatgcacaagcagaagtatgaaactggtgggagtaaaagtcattttccacttctctggattgggttcatcactctatcttggctccgttgtctatttatgatatcagtgttgttcaacagtgatcatcctcaccaccaaattacaattttcctctttcccatctgttcacttatttttgccaaaacagtcatttccctgatgcatcttcaactcattttccacctacttttcaagatatttagtttctattgattcaaagaggcttagacatactccttagagtttttagttttgatttcttacaaaaattcttgtgtgtactctactgttaccatcctgctgctacccacattccaggcaacaatgttaggccagtcctgtaaaacctaatatggccccgaaatcactgcttaagatactagtagataaaagaattaagagacaacattcttaaaacaaaagttttacctcaattgcatggacatttggtgttcacactaccactctacaaatccatagtgtggtctgctttagtctagacaagctgttaatcccttttaaatgttttgtttccaaaaataattttatactgaaagcttgtcatacgtgtaccctgcatgccatcacaacacaaaaaaaatgctggtgccctggatatgattgtggccgtgagcaataaaatcctttgtctttgacccagaagtcttgtatctcctgccagaatccatgaaacttggcaagctaacatgttagcttgcagatagggtaaaatgtcatgccctttataattcttgactagaatcttacataatttccataattatctatttagttagagctctgtggcctgatgagagtcatgaaccacatgtaactctttgcctttattatttaatataacaacaaatcagttcctcagtcactttagccacatttaatgtgcccaatagctacttgtgtcaattaactattgtgttgaaaatccaagtatagaacactcccattatttggagcaattttaacaggacaatgtttgtttaaacattatttagtaattcctatttcataaccaatgacaaaatcagtatgtttatctttcttttttttgagatggagtctcactctgtcgcccaggctggagtgcagtggcacaatctcagctcactgcaagctctgcctcctgggttcacgccattcacctgcctcagcctcccgagtagctgggactacaggcgcccgcaaccacgcctggctaattttttgtatttttagtagagacgaggtttcaccgggttagccaggatggtttcaatctcctgacatcgtgatccacccgcctcggcctcccaaagtgctgggattacaggcgtgagccaccatgcccggcctcagtatgtttatctttcaactcattcttcaacctacaattttagtttcctttatttctaagtttttatatttgtaatgttaattataattttactaattagtttgtcagctttaagtaatattgccggtgcctagttacattctgtaccttactttccaccttactctcccacattagatacatcatttctaaacttcccaaagtaaagttctgtaaaagcagagtcttgagagaaatgttttcaagtgcccacttctgattatctaggatttcctcctggatactttttgacggtaatcaatgacgcctggggcctttctgttcacacacttcctctaataacaatggaggcagagggcggtggatcacctgaggtcaggagctcgagacaagcctggccatcatggcaaaaccccatctctaccaaaaaatacaaaaattagccaggcatggtggtgcatgcctgtggtcccagctactcaggaggctgaggcagaaggatctctttagcccagggaggtggaggttgcagtgagccagaattgtgccattgcacttcagcctgggcgacagagcgagactgtcaaaaaaaaaaaaaaggaacaatggaggttctctttgctccaacttacctgaagatcacttctggttttgtagtgcagtacaatttaaatgaaaaataatttagaatgtgggccagccacatggattttaatgcttctgaaggtagaagaaaagacaattttagatttggtcaaatgaaatcctcatattaacttcttttgagcaaaactgacaacaaaactattgtttccattacctaaatgggatcaatcactgtagatgcccctgaatcataagcctaaatgacattaaactttagtgagtccattaaactttaataaaagttcaaacaatatactatctaaaagaaactatactattttgacagaaatacgttagaagtaaaagaatgcaaaaagttacaacatgaaaatactaaacataataaagttggagtcgctacttcaatatcaaataaaataaagttcagataaagcaatattaccaggcatgaagagaacactgcttaacaataaaggggacaattcagaaagagtacatcgaaatcctaaatatttatgcaccaaattacagaactttaaaatgccttaagcaaatctgtagtgcaaaaagaaaaaatagccaaacccacaattaaagggtagagatttcaacactcttttgtcaacaattgatagcaaaaataaacagaaatgtgtaagggaagagccccatcatggggtggctgttttttttttttttacagtctcactctgtcaccaggctggagtaaagtggcgcgatcttggctcactgcaacctccaccctccacctcccaggttcaagcaattctcctgcctcagtctcccgaatagctgggactacaggcaccctccaccacgcccagctaatttttgtatttttagtagagacgaggtttcgccatgttagccaggatggtgtccatctcccgacctcgcgatccgcccacctcggcctcccaaagtgctaggattacaggcgtaagccacatggtggcctttctgtatgtatccctataggacaagcaacaaagatttgaactgctggccaggcacggtggctcacacctgtaatcccagcactttgggaggccgaggcaggcagatcatgaggtcaggagatcgagaccatcctggccaacacagtgaaacctgtaatcccagcactttggactgcactccagcctgaatgacagagcgaaactccgtctcaaaaaaaaaaaaaaaaaaatggaactgcctctaatctgagtcttgccatagcagcttgcaattctcctggaacataagaaaaaggcttgggagaagctgcctcaataccatcacccatttgcctccctatccctcttaggaggttgttataagacagttgcttattacctgctggtatgtggaatgatgctttctgctctactcctacctagggtttagctacagaccataatgccctttactgtcatctagaatttgttcctcaggaatgtggtctcccacgagttatgttgcagttatctgaccctttttacattagtggtgcccttttaggcatgtggcacaagggctgggagctgtcacctttggctactcttcctttcattgtctctgtaataaactccttgaatctataagcaacttggtgtgtctttctagaccaaatgacttcgttgttggccttgcctgctgtgtgtgcctgactccaccctacatgggccaatacagcttcaatgttcctctggaagatatggggccatgtggacaaggttagggataagatagattccctgcacaggttctcacctacatggtgggataaaaggggagggtgatacaagctctccaaacaaaggatgaaatggagcagtttaggagagataagactctccaagatttagtattagatgggattgcatgagacagattaggggatgacataaaaattgctgaaatctggttgcatatgctctctcctaagggtcaggcaaatcctattctacccatttagggcctgtgtgggtcaagctagagaatattagaagactccctgggatctgatagcatatgctgtctgttgatacatgtttggagtcaggcagctggagatgggattgaaaccagctaccaacttgtgccttacatttaagtgtgttaagtatttctcttgacaaagaaaagcctggatcagagggctattctggtaaattctaacaaacattttaaagaaagatttacatcagactttctcaaacccttccaaaaagtggaggaggagagaacattctctgaagccagcattacccagataccaaggccagaaaaaggcagtatagaaaaagaaaactacagaccaatatcccttaggaatattgtcacaaaatcctcaagaaaatactagcaaactgatggccaggtgcagtggctcacgcctgtaatcccagtactttgggaggccgagatgggtggatcacgaggtcaggagttcaagaccagcctggccaatatggtgaaaccctgtctctactaaaaatataaaaagttagctgggtgtggtggcacaggcctgtagtcccagctacttgggaggctgaggcaggagaattgcttgaacccaggaggcagaggttgcagtgagctgagatcatgccactgcactcaagcctgggcaacagagtgagactctgtttcaaaaaaagaaaaaaaaaaaaaaagaaaatactagcaagctgaattaacagaaggaagggaaaaaaacatattaccatcccaattgattcaggaaaagcatttgaaaaagatcaacatcctctcataattaaaaaagaaaaaactcaataaactacaagtagaaggaaactttttcaacataataaacactatatatgtaagaaaactccctgctaccatcatacttgatgctaatagactgaacttttttttttcttaggctctggaacaagataaagaggcccactcctaccacttcaattaacataactctgggtgttctgtccaaagtaaatgaacaagaaaaaaatttaaaaaggacttgaaattagaaagtaagaagtaatgttatgtctggtcactaaggtgatctttatgtagaaaaccctaaggattccacaaaaacaaacaaggaaaaagcattagatctaacaaacacattcagcaaagttacaggtaaaaaatcaatcagcaaatccagttgtgttgctatacattaacaatgaacaacctgcaaaggtaataagacaaacattcccacttacaatagcatcacagaaaatacctaggaataaagttgatcatggaagtgaaagacttgtacactgaaaactacaaaatattgctgaaagcaattaaagaagatattaagcagatggaaagacatcccatgctcatggttaaaagacaaaaaaccctttttaagattcatatggaatctcaagggaacctgaatagccaaaataatctttttgtttgtttgtttgtttgttttgttttgttttgtttttattatactttaagttttagggtacatgtgcacattgtgcaggttagttacatatgtatacatgagccatgctggtgtgctgcacccactaactcgtcatctagcattaggtatatctcccaatgctatccctcccccctccccccaccccaccacagtccccatagtgtgatattccccttcctgtgtccatgtgatctcattgttcaattcccacctatgagtgagaatatgcaaaataatcttaaaaaagagaaacaacgttggagttctcacacttcttgattttaaaacttaccacaaagctatggtaatgaaatattgtggtactgccataaggatagacacaaagatgaatgcaatggaatacagcacttagaaataaaccctcacatacatgatcaaatgaatttcaataaaggtgctgaaactattcagcgaggcaaggaccgtcttttcaactaacggtgtggaaaatcgggatattcacatgcacatgaatgaattagacctttgccttatatcacatacaaaaattaagtcaaaatggattaaagacataaacttaagagctaaaactatacagttcttagaagaaactattggaaaatcttcatgacattagatttgtcagtgttctcagatatgacaccaaaataggcaacaaaaggaaaaatgtagagaaattggactcatcaaaattaaaaaatttctgcatcaaaggatactactagcaagagagtaaaggctgggcatggtggctcatgcctgtaatcccaacactttgggaggccaaggcgggtggatcacgaggtcaggagatcgagaccatcctggctaacacagtgaaaccccgtctctacaaaaatacaaaaaattagccaggtgtggtcgtgggcacctgtagtcccagctacttgggaggctgaggcaggagaatggcgtgtacccaggagggggagcttgcagtgagcggagatcgcaccactgcactccagcctgggggacagaacgagactctgtcacaaaaaaaaaaaaagaagtaaaaacacaactcacagaaatacttacgaagcatatatctgataggagtttaatatccagaataaacaacttctgcaattcaaaacagcaataaaactaactgaatttttttattgacaaaatacttgaatcaacgtctctccaaaaatgtataaatagcctataagcacatgaaaagaagctcaacatacctggtcactagggaattgcaaagccaaaccacaattagaaaccaattcatacccacttaggatggtcgttattggaaaaaaatggaaaataccaagtgttggtgagaatttggaacccttgtgcaactgttggagggaatgatgcatcctctgtgaaagacagtttggtggttcctcaaaaaattagaattaccatatgatccaataattccacttctagatacagaccccaaagaaagacccaaccagatacttgtataccatcgtgcacaacagcatcaatcacaataaacaaaaggtggaagcaacccaagtgtgtggacagatgaacggataaacaaaatgcagcatgtacacaccgtggaatattattcagctttaaaaagagaatgaaatacctggtgcttgctacaacatgaatgaaccttgaaacattacgctaagtgaaataaggcagaggcaaagtgacagatattttatgattccacatatatgaagtgcctagaatagataaattcacagaagcagaaagtaaaacgcagattaccatgatctatgcgtctgcaccccacccaccaccagagatctctacatgctttcacttgggtaataccaatgacaagaggaggaatgtaaagagtcttttatcctgtctctgaagccctataagagggaagtctcaacttccatgctgggagtatgggatatggggactttgactacacagtttctgtttgggattatccacaatttctggtaatagatagcagtgatgcttgtgtaacactgtgcacatgcttaaagtcacttaattacacactttaaaatggttaaagtggcaaattttatgttatgcatatttcaccacagaaaaaataaataaatacataaataaataaatgaactttggaaaaaacaaacaaaccaacctggcctgcatccagtctttcttttccatagcatctatgcagactgcccgaatcttcacactttctttactggggggcaggggttgcagtcttgctctgtcatccaggctggagtgcagtggcatgatcttggctcactgcaacctctgcttccagggttcaagcaattctcctgcctcaccctccagagtatctgggattacaggcgcctgccatcacacccggctcatttttgtatttttagtagggatgggggtttcaccatgttggccaggctggtctcgaactcctgacctcaagtgatccctccacctcggccttccaaagtgctggcattacaggtgtgagccactgtaccctgtctgatttttcatgctttcttttgcccattttcaagcgattttcctcccagagactgcaagatagagttcacttaaattctgaagacatctttaacagatgagcaaagttccccttcatgctaggtaacactttgatcttcaaggtactcatggttaaaagagcatatacatttcagaactaaaataagatgaaaactactgattatttgtttaaccttagcactaaaaatagacctctgatgttagagacttcacaatatgatttcttcattaatctggatatatgtgtgcatgtgtctctacgtgtgtatctcaacttattttagctttaaaaaaaattcaaaatcccctttaccatgaaaacaaggttatgctttcgttttcataaagcctcttaaggtctaagcagaatattgcatatttgtaatttaaaatattgtcattaaaaagtgcatttggtgagacctagaaaatggtcacttaaaaccaaaagtaaatacaatgctttgttgacaggtaggagctgcttcctctttctatctgcctcccgccatgccccttctcccaacaaccccttagcttctagctaaatagaaaggatgttctagcagctactgagtagcacctgaagtgcctgtatgaagtgcttggtctgtgtttctgttaaaaatacgtctaacagaggtttaggtaaaatttatcctaaaggaataagaaggtaaattattttgtgaatgaggctctgagctgactcactgtatgcattgttgtaaaaatgtgtaactggaataacatgttgcttgtttgaactgtaagtgcttacaaagtattttttaaaatctaactttgaaatattttactgtgtaagtgatgtcttgttagttggcaagttaaaaatctttttcagggtccttggctacacatcagcaggaataactgataagtccccaaaattcgagagtgttgcttagatttttcttgtaacatttcttgaaacaatgtaggtagaatcacattactgaatccccctggcaaagaaaaaactgttgccttttacaaagaacagtatattcctgatctagaagttgcagcttttggaaaagttgccccatttgtgtccgggcaccgtggctcacgcccgtaatcccagcactttgggaggcggaggcgggctgatcacgaggtcaggagattgagatcatcctggctaacacagtgaaaccccgtttctactaaaaaaacaaaaaattagccggacgtggtggtgggcgcctgtagtcccagctactcgggaggctgaggcaggagaatggcatgaacctgggaggcggagcttgcagtgagccgagatcgcgccactgcaccccaccctgggctgcagagcgagactccatctcaaaacaaaaaacaaaaaacaaaaagttgccccattcgtgatgcagagttctgatggagagatatttgaagttgatttggaaattgagaaataatctgtgattatcaaaaccatgttggaagattttgagtggatgatgaatgatgaaggatatgatgacctagttcctctaccaaatattaatgcagcagtgtttaaaaaggtcattcagtggtgcactcaccacaaggacgaccctcctcctccccagggtgatgagaacaaagaaaggggaacagaccatactcctgtctgggatcaggaattccttaaagttgaccaaggagcactttttaaacttattctggctgcagactacttagacatcaagtttccttgatgttacatacagcactcttgccaatatgatcaaggggaaagctcctaaggaaactgacaagtccttcaatatcaaaatgactttatggaagagaaggaagccgaggtgcactaagagaactgtggtgtgatgagaagcaaaatgtgtctgacactgtaacactataaagacagctccaaacactagttgtactgctgtgcttacagtttctaatgttagacaaatgcagcagcaaatcaattctgttagcagaatactgtcatcattgcatgagcaatctgagtagtttccaagtgtatggctaagtttcttctggtatgattgaaagtttctttttttttcctcttaataaaactaaactgtgggttctctatttaaaaaaaaaaagaaataaaagaaaaattaaaacactcccagtttgtagatgacatgattttctgagtagaactagttaagtgaattcagcaagtttttaggatataagatcaacacacaaaaacatactaacgacagacatgtggagatggactttaaaacacaatatgatttaaaattatctcatagaaaaggaaatatttaggtacgaaattatgtacaaattttaacaaaatacataaaagatctgtatcctaaaatttagaaaatgctgatgaaaagaatcaaaggagacctaaataaatggatatatatcatgttcatgaattggaaatttcaacatattaaagatgtcagtacttcaaaagttgacctacagatttagtacaatttttacgaaagtcccaacaaaatgttttgtagacataaacaagtttattctaaaacgtatatggaaaggcacaggaccaaaaatagtgaaaacaattttcaaaaagagtaaagtgagaggaatccctgtgcctggtgtggctatatgtctacagaaaacaatgcaatgtgttgctggcagaggcagagacgcctagaacccaggaacagagtagcaaatccaaaaacagacccacacaattatgcccaatgaatctgtaaaaacaattacatggaggaagggtaacctttcaataaattgtgttgggacaattattatgcatccatggataaaataatgaactttacatttaacctcacatcttaccaaaaatgaactaaaaatggatcacaaattctccccggctggactgcagtggcgccatctcggctcactgccacctccgcctccgggttcaagcaattatcctgcctcagcctcccgagcagatgggattacaggcgcccaccaccacgcccggctcatctttgcatctttactagagacggagtttcaccttgttggccaggctggtcgcggtaattcctgacctcaggtgatccgccctcctcagccttcctaaatgctaggactacaggtgtgagccaccgcacctggcctaaaactataaatattttagaaaaataaacataggagaaagtcttcaggacttaagactacgtggtgtttataaaatagacggtgctttcataaaattatgtgttttttttaaataaaactaaacacgtatcatacagcccagcaataaaagttttaggcattacagtattacagagaaatggaacatttctgttcacatgaaaacatgtgtacagttgttcatagtggctttatttgtattaaccaaaagctggaaatagcccaaatgttttcctatagtgaatggttaaacaaactgtggtaagttcatagaattatctttcctttgagatgccattcctgaaactataaaaacttttctggaaaacctaagcaatgaatttatcgctgtttcgtttgtatcgcctatttaaggaagtaaaatgaacgataatttttgccctcctttacctatggtcatgtgataagcccttaatagaagtcagcttttgccagcggcgcccagtggctcacgcctgtcatcccagcactttaggaggccgaggtgggcggatcacctgagatcgggagttagagaccagcctgaccaacgcggagaaccctgtctctactaaaaatagaaaattagctgggcgtggtggcgcatgcctgtaatcccagctactcgggaggctgaggcaagagaatcgcttcaatccgggtggtggaggttgctgtgagcggagatcgcgccattgcactccagcctgggtgacagaactggactctgtctcaaaaaaaagtcagcttttattatgaggggctctccatctccagatgcctgtaaggaaaggagtgagctaagcatctggaacaccgtgggggttttggactgagtgcctacggtgtattgggccctgtgtaggagtttcatatatattattttataacactatggctagctcttactacccaaattttacaagttaggaaactaaggattagcattacttactcaaacaaacagtgggtgagtggggaaattggaattcatatccagatgtctctgagtacagaaaccatattctctataccacacttttttgtcccttcataacttccatctgtgtgagtggccaggagtaacggattatgcaactgcctgaagcgctctggtcttgtgtccaatgcacaggatgcggaatattcctttaaaatcttcctgcccattccacggctgagtctcatctctagccagcagaaacccatttttagtggctggtaagccactaaatttactctttgtccccaaaatgaccatcattgcatatttaagtacattttatttctagatgcctgattcatttcaagtctatgtaaattgttagtttcttatgaacaattaaatttagagtatacatatgtcaacaacttttctgttagtgaaactgtgagatcctgtcactcagtgtgacatcgctgaaaattaagggattcgcaatcttcgctgacttgtgttccaagtctgggtcaactatttgctgtatgacattggcaatattatttaacctctaatagagttcatctgtttatctattaaaacagtgaaatgatatttatctgaaagaatccagtatattaatttagaggtacacccattaacaaacacattactttatgtaaattggtaatctatatctgcttctgcttattcattactttaaataactacaaagaaaatattcagacccagggacataaaataagcactcaaataacgtctgttgaaaaaaatgaatgtcacttttgtcaaattatttctaaaaaaaaaaaagtaacttatttagaaaatctcaaatctacattaaggaccttgtattttagcattgtcaccacttttactgagaggtcagtagggactattcctgattctggaaggcagaacatagataaggagacccacaaaattggagtctgatctgggtcacattttcaacatttaaaattaccgtgtgactttggtgagtcatttgaattctccattcctgttctctatctataaatagaaataataaagacatttattcttaaattaagtttcaatttttcatctataaaatcaagtgctaaatatacacatttagcaattataatgctatacagagatgtttctgtgatttctattcttcttccaactttgcaccattttgcaaacatcctcatgttaaaggttgcagtttcttccagtttcttactaccatgatgtgctcataaatgcttgaaatcccatttgaataggattcaggacagcgtaaggtgttaatctgaccatttgtttttaagagtctatcctgtttaaagccatgagatacatttctaagtgttctgaactacatcatttaaatcttctcatatcctgtttttaaaaaagtggtaatcttgggtgaagccacttgatcaataattttttaaggtccttaattttctcaactccaggaaattttcctatccattggaccacttgaatttcatctttatgttttgtaggtgtttttggtaatttcctttttactgcattccatgacttttaatgtttccatttagggaattgttctcaaagaatttgagttgaaactcatactacatatttataaaatgtataaattatttacagcttagcattaaaaaaatcaaatatgtccaattcaagtagctggtacagaatcacttattttcttaaatatgatacgttacaattatatcatgttttaaatctctaacaaacctgactccataatatttggctacaagtgtatataatacaaatgcttatatgatggctgagaaaacaaaaattttcattcttacactttttaaattgttattttgtcttcttttaatggatacttggtacagtttcacctggatgctctctatattcaggggaattgcagagttacagggatactgtactatgtggaattgccccatcaattaaatgcaggatcatgacaatgagcaagtaaggaggatttgatgccactcctttacaagaacgccttgctagggtttggctgtgtccccattcaaatctcatcttgaattgtagctcccataattcccacatattgtgggagggactcagcgggagataattgaatcatgggggtggtttccctcatactgttcttgtggtagtgaataagtctcacaagatctgatggttttataaggggaaacccctttcacttggttctctttctctctgcctgggaaaagcatcccttgctcttccaccataattctgaggcctcctcagccatgtggaactgtgggtcaattaaacctctttcctttataaattacccagtctcgggtatgtctttatgagcagtctgaaaacagactaatatactcctccatgggaagaaaaggtttgagggtctttggagaacagggtatgagaggaggatgcccagtaagggggtaccagtgcctgcatctggaggcaaatctcacaggcatttatcacagtcagacattaaattatgttgtattattttaaatgtaagcagttgacaattatgccaaactagaagctactgcttcttttagaagtaggtaataaaataattaactctgaagtaatgtactgttcagaagcagagcagatatacataaacctaaacactaagagctgggtctccaatactaaaagaacgctactttggcactccctgatagagggagcgctattaataatgtggaaacgtttttgctaaaagagaaggattaacattcatgccagcatccaaattgttcttcttaagatattgtatatttatattataaaatatgtcctgtttctgattttattaatttatttcattcattaaagatatatcagcaagtggcagattaggaagctccagggccatattttcccataaaaatgtcaaataaaaaatatatagaccaaagtcactttgtaagaactcctaaaattagctaagaaacaaagcaaatgcctaactgaacaaaaggccacattggaagcagtatgaaatttcatggcatttttcttgcccttaacccacctcctcttcaacatagtgtgatgtgatcaggaggaatttgtccaatccaagttccagcctcaagctggaagaggaagagaggagcttatctggagattgactggaagactatttctatcttacctgatttaaaaagctgatggaagtggtggcatagtttgaatagccattcaaatgaccttgaataggttcaaggtcatttaaaacagacaggcaccatggtgactaagagccacaagcggtcagaagacccccggtggcacagattatagacaaaggaaaacaataaaaattccctgacctctaagaagcagcagcaatatgcctcttggggaaattaagacatttaaagcagccttgtatatggggaactggaacaaaagcatacacacaaggcaaggaaagacacatctccagtaaaagtatgaaaggagcttgtacctttatgccaggatgattagtaaaggtcttcccctgcatagagccagtccacaaaaagctaggagacaaggctacttttttcaaatgctcaattttcaacaaaagatcacaagacacacaaaggaacaggaaaacgtagccccttcaaaggaacaaaataaatctccagtaactgatcttaaagaacagcagagcttgggcttatttgataaagatattcaaacaataaagatgtctaaagtatgctaaatgagctgaaggggaacatgaacagacatacaagcaaactcaggaagatattttatgaatgacatgagaatattaacaaagagataattttaaaatcacagaaaacaaacaaacattctgaacctgagaaacagagtaacttagttgaaaaatttactatagggagacttgatcaggcagaagaaagaatcagtaaacttaaagatatttgtcattgttgaatctgaggagcaaaaagaaaaaagaatgagtaaaagtgaacagagtttaagggacatatgggacattgtcgagtgaaccatacacattatggaattaccataagaagaagagacaaagagacagggagcttatctgaagaaacaatggatgaaaagttcccaagtatgaggaaagaaatgaatacacaggctgggcgcagtggttcatgcctgtaatcccagcactttgggaggccaaggcaggtggatcacctgaggtcaggagttcgagatcagcctggccaacatggtgaaaccccgcctctactaaaaatacaaaaaaaggttagccgtgtgtggtggtgtgtgcctgtagtcccagctactcgagaggctgaagcacaagaatcatttgaacctagcagtcaggagttgcagtgagtcgagatcacaccattgcactccagcctaggtgacagggtgagactatctcaaaaaaaaaaatgaatatacaaatacgagaagctcagtgaattttaaatcggatggatccacaaagatccacactaagacatattataatcaaattgtcaaaagtcaaagagaatcttgaaagtagcaagagataggtgacttagtatgtacaagaaaatctataatattaacagtgaatttcttatcggaaaatttgcaggccaaaaggcagtgggatgacatatttaactgattttttttaaactcctgccaactgagaatactatattcagtaaatttgtttttcaaaaaaatgaagagaagtaagacatttctacagaaaaactgaggagttcgttactgttgggaaaggcagtcttgtgcatgcaatcttttgaccctcacttggccatgtgacaatgggcctaaggtctggacaacttctttatcacgagaataaagaaccttcatatcctgtactgggattatcacttgtgtgggaatattttagcctgtttcagactcaatgtgtattccttcgttcagcttaaaattgcacatattatggcacctagccaaacctgatactacatttgccccctgcagggaggggaagggttcttctgtagcacaagagaggtatgtaccgccaaattgtcctgtgtcagctgctgggcaggacctactggccatgggagacccatgaccactagtggagctggtcgtgctctgcctctactctgtgtaagtaaagcattaatctattcagcaattggctgtactgtgttttccttggcaactccaataccaagatgcagtaggcagaagtatcagggttttcactcctggtgatagacaactgatttcacttgcttgatagtaaccactacaccattcctattagaaatgttaaagaaagtccttcaacttgcaacaaaggacactaggcagtaacttcaagccctataaaaatttaaagttctttggtaaagataaatgtatggacaaatatttaaaaattgtgttattataattttcatttgtaatgccacttttaattatttaataggatttaaagtttaaaaagcataagtataaatctatattaatgggtacacaatatagaaagatactttgtgacataacataaagtgggagtgtgaagagagttataaaggagtagagtttttgtatgtgattgaagttgctatcagtttaaaattgatttttctaacttaactgttttatgtaatccccatggtaacacaaaagatatatctagagaatgtacacaaagagaaataagaagaaaatcaaataaatgtcactgaaaactcaactgaacataaaggaaggcagtaagtgaggaaataaggggaaaaaacctataagacatagagaaaaattagcaaaatggcaatagtaaatctctaatcataatatatattttggcagaatggataaaaacacaagatgcaactatatactgtctacacaagacttgttataaatccgaggacacgcactggggaagggaaagaatggaaaaaagataattcacgcaaatattaaaagaagagcagcaagtggctatatcgatattggataaaagagatgttaagttgaaagctgtcacaagagagaaagagggacactatataatgacaaaagggtcaattcaccaagaagatataacatttataaatatatatatatatttatatatatatacacagtaagcatcagagctcctaaatttatgaaacaaatgttgacataattgaaaggaggaaaatactgatgtacaagaattatagggactttaatgtcacatttcaataattgattaaacatccagagaaacgatcagtaaagaaacagaggacttgaaaaacattatagaccaattgaaactgacagacatatacaaaacacttcacccaacaacaatagaatacacatttttttctcaagtatacatggagcataattcagggtagaccataggctaagcccccaaaaaagtcttaatacagttaaaagattaaaatcatcacggtacctttttttattatgatggaatgaaactagaaatcaatagcaggaggaaaactagaaagtctacaaatatgtggaaattaaacaacaaacccttaagtaaccaatgggtcaaagaaaaaaatacaaggaaaattagaaaatatactgagagaaataaaaatgtaaacacagtttattgaaacttgtgagatgctgaaaaagtaatagtaagaaggaattttatagctgtagatgtttatactataaaagaactaaatcaacaacctacctttattccttaaggaaatagaaaaagaagaaacttcacacatctggcacacaaaaagatacaataaagattacagcagagataaacgaaattgagactagaaaaacaatagagaaattagtgaaacatagggttgactatgtaaaacatgaacagaattgtcaagcctttagctagaacaactgtgaaaaaggaggaagctcaggggccgaagcgcagtggctcacgcctgtaatcccagcacttagggaggccaaggctggcggatcacgaggtcaggagatcgagaccatcctggctaacacggtgaaacccggtctctactaaaaacacaaaaatttagccgggtgtggtgtggggcgcctgtagtcccagctactcgggaggctgaggtaggagaatggcgtgaacccgggagacggagcttgcagtgagccgagatcgcgccaccgcactccagccttgctgacagagcgagactctgtctcaaaaaaaaaaaaaaaaaaaaaaaaaagcccccagtttacatcacactcagtgttgaaagactgaaagggttttctctaagatcaagaacaaggcaaggatgtccacgtttgccagtctattcaacatagcacttaaagtcctaaccagaacaattaggcaagaagaggaaatttaaaaagatatccaaaatggaaaggggaaaattaaatcatccctcttctcagattatatgatcatacatgtagagaaccctaaaaatatcacaaaaacctattagaagtacagtttacccagaattctactactccttaccaaggagcatctattcttatactgatgtatgacatactttcaaactttctcaatatcaaagagattgtctcaccagcagctaaggctgtattgtactgatctgtaatatttgttatttcaagctggaagatattatctgagagtttgacatatatttgatcttaaagaatctcacagaaaaaggcttctcttatactgtcaaattttgaagtaggaaaaagactttcgagattgctaaaaaaataacctgtaacatacctaaaatgctttgtatcctgataatcccagaattcaggtaaaatgttgatttgatgttcacaaagggagtaatattttagttacttaaatactaacatgggtataatttaaattactctggttaaggatagtacaagactctgtgactgtaaacacttcacctgagccaagtttgaattatttaatgtgttatgtcatttatttattttccacaaagaaatgtccttccccctcaggctgaaaaaaaaaaaagtctagaatatgaaggagaaccatgggaagagaaaggaggcaaagaactacaaagacagatctcacaaaatggaaatgaaatgtattggaattaagaaggaacaccttccttttagtaatatcatagtacagccaacgtaaaacaagaacatattattgtacccaaagtcaatggactgtgtaatgtccaggacaatccatgactcatcacatcccacagccatgttaacagatgccaacaggctcagcggtgcccccagagctacgcctgctagaggacacagcttaaataaagtgaaatacaataatctatgacaaagtggaaaaaaacaaggaagtggaaaaaataagaatgttctttgctgatccacatgttccatgagaaatcttatcaaggatcttataaaagtgataaaatcatagatgagaaagacagttgcagaggtcaaattgcaatttcacattttgtttaatttgttgaaagtatttggtaaacaatctgtgtactcaaataagaataattcaaaatgttgccaccatgttttacaaattattttcaaggataagccatcttttcttctaatgaaattaaacaacagttattaatagtttggcatttctataatggttttatctttgttgattgtaaagtgagtcctcacaacataaaccaaaatgccagcatttcacgagtgcaacatagcagaactttttttttttttccgacatggagtttcactctggtttcccaggctggagtgcaatggcgtgatctcagctcactgcaacctccgcctcccgggttcaagcgattctcctgtctcagcctccctagtagctgggattacaggcatgcaccaccacgcctggctaattttgtatttttagtagagatggggtttctccattttggtcaggctggtctctaactcctggcctcaggtgatccacccttcttggcctcccaaagtgctgggattacaggcataagccaccgcgcccggccaaaacacagcagaacttctattgctttacggggaagggacttccataattaacatggactgaaaaaatgaatttaaaataagtgtgaaagggggcatctgacatgtgcaatgatcattaatctcattgcgggacctttaaaatccacctacatgtgtgagggaagtgtttgtctctatatttttgttcctctaagtaggtctgaatcccattagggtgaggcacctggggaagcacctaggaatagtgattcctgacatgtttctcacaatttaatacttcataatttagaaagttttcccatacattctctaatttgagtttcacagagatcctgtggaagaactctgggcagatagaagtccagaagagaaacaacagctcaggaatgtcacatcattggtccaggagctgtttccttatttcctctgaacctaattttactgagaatattttttttccttagaaaaaattctaaagacctcaatttttttttttttttttttttagatggagtttcactcttgttgcccaggctggagtgcaatggtgcaatctcagctcactgcaaccttacctcccgggttcaagcaattctcctgcctcagtctcccgagtagctaggattacaggcatgtgccaccacacccagctaattgtgtatttttagtagagatggggtttctgcatgttggtcaggctggtcttgaactcttggcctcaggtgatccatctgcctcagcctcccaaagtgctgggattacaggcgtaagccactgtgcccagtctgcaacatatttttaatttctgaaaattatactttgaaaataaatattctagtaataaaaataggtaactcaagggacacagagattcgcttttggtcagagaaaccatacttccctttactggaagactgatttttttttttttaactactgaactatgacaggaatgttttgaactggagcactaactatgggctacttgtgtatctaggcccttcctcaataaatttacaatctataaaagaagaagaaaaccagataatacaacttgtaagtagtactgtgagagatttttagagaaaaacgtgctggcatataaaagggtcatgaggctctattgactcaaacttgttcaagaagtaaacaaaagcctaaaagcctaatgataacaaaaatgtgcatttataagtatgcagttttaaaaagaacgctacattgattttctgccaccactctctaagactcccttctgtaggttgctatgctgggctttatgacagctctaacacctgctcctccccagttctcctttgcctaatttctgatgtaggtgttcataaaaatcctaccccaatcttctttgcttctcatttccatcctctacttggcaattctatccattttaccaggtttaagtaactatcactgctatgtgttcatgctcaatttatcttcttagctccagaatagaagctactgtggattatttatatgtgggtatctttgtgtgtgtgtgtgtgtgtgtgtgtgtgtgatggagtctcactctgtcacccaggctggagtgcaatgacgtgatcttggctcagtgcaacctccacctcacgattttaagcgattctcctgcctcagcctcttgagtagctgggattacaggtgcctgccaccgtgcctggctaattttcatatttttagtagagatgggggggtctcaccatgttggccaagctggtctcgaactcctgacctcaaatgatccatccaccttggcctcccaaagtgcttggattacaagcatcagccacctcactcggcctatatgtgggtatcttacagattacctcaagctcaacaagcacaaaactcttctaggcagcaaatctctaaaacctgctcctctcctactcataattgccccattatcactcaggcttgaagccctggaattgtctttatttttcaaacatcctcttctttgattctctttctatgtgcatttagatctcctctttcaagttgccaaaggtacctttatattatatcatgtaaatatttttgatattttactcttctaaatgattaagttgtttggtaaagaacaaacatccatactcttcaatcttctatccttagctttcatgattggagccaattctatgatttcttattcatccaatctgtacttccaacgcttccccggcacatcctgctgaaatctctatgtcggcctatcatataggataacagtcctgtgttcttattataaaatacagaatgtgggggatttaaagaagaccatcttttacctcctgtgaaagttaaagggagcatagtctacaaggccactctcacttctaacaccagttgcaagttcaagggattcccaaaactactttcaggtttggtaattcactagaagggctcacagaactcactgaaaggtgttagactcatggttatgatttattacagtgaaagaatacagattaatatcagtcaagaaaagggaagcatagagaaaagcccaagacagtaccaaatgtgaagcttcctattgttctctccctgtggaatcaggacagcatttcctggcatcaatgtgtgacattgcttaggtagtactgccaagcagggatgctcacctgagccttgatgtccagagtcttatccattactagatagttgactgtgcatgtggctgtcttaagttttcagacctataggacatgtagcctgtgactcaaagctccaaccccactttaaatcacattgttaatatcttgctggctcaaggtccccaggaaagcaaagatgttcctatcaggcatgatgttccaagagctagagattacctccaagaagccaagggtaaaacccagacctttctttaggcaagactagcctgggcaacataggccccatttctacaaaaaaataaaacgttatctcatggtggcacatgactattgtcccagctattcaggaggttgaggcgagagggtcccttgagtccaggagattgaggctgcagagagctctgatcatgctgctacactccagcctgggtgacagagtgagaacttgtcaaaaaaaaaaaaaaaatctttactatggaccctcctactttcttaggttttcaagatgtgtatgtagataaaatggatttgtaactgggctgaaaaacctgtctttgaatctggaaacacctggatgtctggtttttttactcttggctaagctagggtcagtaagatttatgtaattctgtttatgttctgacccggagactttaatacttactttctttactaatggtttgccactgacataaccaggtgaaaagcgtggcttgcttatatgactacaggaacttataacacccctataagggcttctctgaactcccacaaagccaaaattcctggtccagatcttagaggttcaaattagagacacagcctggtcccgtgtatgaaaagaaggtggccctggagagttgggatgtcaaaatgtctcttgtactcccaatgtttgcttgctttttccttctcttgctgtatcacataatttgcatttttgtaaaaaaaaaaagtacactttgtgtaatctgatgaatcctttcaaatatatgaactgtgggaaaaaaatataccagagtttattacacttgcagaaattttactaaggattagaaaaatttcaaatatcataacctgaaccaagaatttcatatgtaattaacaccactatctccttcatagttcagaaaagtgataagatgaaattcaataaataagtctggggtttcagtaaatataatgtcaaccactttcttactattgaataacagtttaaattttagttacttttatgattttaaggtacttcattaatttaactactaaaaatatttgttagattgcacactaagtttcagactctcaaaaatgatgaaaattaataaaaactatattataaagaagtagttgaccacagcagagacagaggtatagaaagaaaactgagcaagtctggtcagaggtaggcctggcacaaggacctggagaaggcagtgtcaccgagagccggtggaggaaatgaggctccataaacagaactttggttgtgatctctggttttctagccaaactgtcttgtaatttttctctcagattctcaaagaaatgggcagcaattgtaaagtgacagtaatgattcagctaattaccagacaaaaacaaatgatgacttaaaagcaccatctctcaacaagtataatttaggccttctatggtcatggattaaaatacttaatattgttgacatgtcaatactcctcaaagtaatctatagatttaagcaatcccgataaaaatcctaatgtctttttttttacagaaatagaaaagtccattctaaaattcatgtgaaatttcaaggacccaaaatagctaagacaatcttgaagaaaaagttaaaggactcacactttcctgactttataatatgttataaaactacagtaatcaaaaccaatatatttctggcataaagacaggtatatagaccaatgtgataaaacagagggcctggaaagaaacaatcaaatatttggtgatgtcagataaggataacaaaatcactcgatggggaaagggcagtctctttaaaaacggtgttggaaaaactgaatatctgcatgcaaatgagtaaaggtaggggcttatcttacaccatatacaaaagttaactcagatggattaaaagcctaactgtaggatgcaaatctatacaactcccagaaggaaacatggaagaaaacttcacaatattagattcggcaatgatttcttggatatgcctccaaaatcacaagcaacaaaagcgaaaatagacaaatgagattacatcaaacttaaaaggttttctgtaccaatggcacaatcaacagaatacaaaagtaacttatgacatgggagagaagatttgcattatatatatatatatatatatatatatatatatatatatatatatatatgggttaatattcagacaatctaaagaactacaattaaacaagaaaaaaaatcaaataacctcattaaaaaatggagaaaggggcttcaggagacatttctcctaagatgatatacaaatggccaacaagcatataaaaagatgctcaatatcactaatcattagaggaatgcaaataaaaccaatgtaaataaaatgataactgctatggaaaacagtatgccagttcctcaaaaaattcaagacagaactaccatatgatctaacaatcccacttcttatggttaattttatatgtcagctacactgtgctatggagtactcagatatctggttaaatatttctagatgtgtccatgaggatgtttctggatgaaattaacatttgaattgataaactgagtaaatcagattgccatttgcaacgtgtgtgggcctcatgcattctatgaaggccagaatagaataagaagctgaccaaaaaagaatttcttctttcttcctgtctttgagctgacacgttggtcttctcctgtctttagattgaaatttatgccactgggtctcctgggtctgaagccttgaaacttagaccataaccataccatcatctctcctgggtctccagattgtcgactttagatcttcagcttctcagcctccatagcacataagccaattccttatattaactggataacctagattagtacagtatataaccaaaggtactgaacacaggatctcaaagagatatttgcacactgatttcatagcagtactattttcaataaccaagagtcggaggcaacccaaatatccatcaatgaaagaatgagataagcaaaatgaggtctattcataataaaatattattccactctaaaaaaatgaagtactgatatatgctataacatggatgaactttaaaaacattaggctaagtgaaagaagcgagacacaaaaggtcacatattgtttgatctgatttatacgaaacacccagaaaaggtaagtctatggaaatggagaacagactagtggttgccaggagctgggcaagggagaaatagggagtaactgcttaaaggacatgtggtttcctttagggttgatgaaaataacttggcactagctggaagtgatagctgcacagcaatgttaacgtgctaaatgccactgaattatacacttaaaatggtgaatggttaattttatgttacacgaattttacatcattataaaaatttgacccaaaaagtatgatttgaatactcttgatttacaataatttattattaaatccttacatatgggtcttccaggttaaggttgagttccagataataaatttagtaaaatggccctacaactgtaaatatgctgcatttcaaattgcatgcatatgcaattttgcaaaatagataggcttttaaatgtttgataagcacattccaaaaaggcaaagtcagtaaaaaagtaaagctctcaaaattaggatttgactactttgttttcaaaaatattgcattaatatttaacctaaaattgtaatttctaaatatcattcgataaaaaaccagattactaaaatctgaaatataatccaaagaagaaagtgctaataaaattaaactattttttctgtgttttttgagacaaaattaaactattttttcttcccaattatctcctatagaaaactcttttctccaagattatttacacaaaagactgagaaaacaagattatacacacacacacacacacacacacgggtgcatgcacacagtttacagtaaactacactgactctccactttgtcaaaacaatagtctgttcttggaattattctgtctctaatcttaatcattcattgaactttctcagttacatgtcctataaggttataaccatcatattctactctaagggtgccaagttagtaaacaggggtggcaatgagattcacagtatggtccaaagagatttgatacggtctaattggacataggtatttgttttgccctctttttctctcttgccagaaaatgttcaaattaactctcatggcctgccaaaacactactttattaatgacttggtagagcaatatactttcctcattgaaagtttgtagagcggtatactccttgctgtcagtgaaacattcaaatagaaagtccaatgaattaaataatagatgtgatagttttattaacatttaactttgtcaaaaggatcattgagaagacaatcttttttcttgcaaacagaaaagcggtagaaagactaaacacgactttttattatttctccttatatttctccagcattggaatcctgatctacttagtaatgctttctcaaaacactagctaccgtttatgttggtagaaccagaaaaatgccctaatgtgtccatagaaaagaattaattttggccaggcgccgtggctcacgcctgtaatcccagtgctttgggaggctgaggctggcggatcacgacgaggtcaggagatggagaccatcctggctaacacggtgaaaccctgtctctactaaaaatacaaaaaattagccgggtgtggtggcagcgcctgtagtcccagctactccggaggctgaggcaggagaatggcgtgaaccctggaggcggagcttgcagtgagccgagatcgcgccactacactccagcctgggggacagagagacactccgtctcaaaaaacaaacaaacaacaacaacaacaataaaaaaagaattgagcactttatgaaatactttttatattatactatttcttcctttgagaaataccattattagtgcacaaccgatcaccatagcttaaaatcagattacaaaatacaaggaaaatacttacaataggaaagttcacccctaagcatttctttatgacacttttagccatatgaactcaccactatttattagaatgcaatatctcaaaatagaatatggtataaaactgattttttcaaataaatacataataaaaattattaaaatatataatttataaaatctaaatgtttactgatacatgttgtatttaatgttaatatatccaaaaagtttaggctcaaacttcataatagtgacccttttttctcagcttcccccccaaaaaaaattattaacctttgtgtatttctctactttgttcacagatacaaaggccagccagatggagctggtcaatgttcccagatcttaagtgcagtgactcaaatctaataaaaaggcatttggaatacagcattgataaagttgtatgactgtacagggaaacattctgcttgtagccatgagatatgaacttctgtttactacttcttctaatagttactagaaatatgagagccaatagaccctttatttttatttcaccctttcctctgagttgtattaaatgacatttcgaatgtcaaatgaatctgatatctacagtcaaacataacagcatcaatggtaaatgtggccaaggagtcagatatgtcaattctgcgtgaattaatctgtttgtgcaaatgatatttatcattacctatgatcagcacttttagctttatcatatcataatttacccaatatgtataggtgtcaacatgtgtgaagataggcaccagataagcaagactcattaagatgttgccatagattaatcctacagagtagaagcatttggctgctctgatttttaagatccctgctttagagcctagaaaatatcatgaaaatgaattaatcatttttcttttcagtatcgtcaacaacctttagtattggagatgttataggaaatgactacctgcttgtaattccatttttagtcaaaactaatacagaagtatttgctagatttggaaatacccaaatgtaagtcagtggcctaatctctaacgggtttaatagcctattttagatgagatcttttccagtaagtgttgtcttccagattttcatgtcctctcgctaatgttttccaaggtggaatttgggcatatgagggctcatgtaaattcatggcattgggtgggtggagagagtttcttgggacatatgagtatctgtgttggtctccactggtcaggtccttcagtccttagatccttagatgacatcactaaggtatagttaatctatacttaatcacaggtgttttttttaacaccacttccaaagtctgtggttgctacgtcccactggccattcagttggcataagccatattcccagaaacaagtacatcgccctttgctgatgggtgccacatcatttctgctgatgctataggcactccaaactctgattgtaaggcctacttgattgctggcattgagtagcattgctgcccttgactacagactcaattaacttcctgatcatttcctctgttaaattgtacccagattctcagctaatatatgtgttgtcttgaaagacatgtgaaaaactctgtgccagagggaaaagaagagctctggatggtctcactctggtaatcatatgcttccacttccactcacaagtcattgggcagaattagttacatagttccaccctacctcaagtggacaggaattacaattatgctgtgtacctgaaagggaaaagaactggaaacatttgttgaacaggctaccacaagtaccctgccaagtgatctcccttcaaaaactcaagtaggaagctaaattaaagtcatcatctcttcttcacttgttcctcagtgtaactaagaagacttgacttctgggactttagctctgatagaggagtttagatatgtgtctcacctcctgaactttctgccttcatccccttttcattctcataatctgtcatgaccagaaaaaggggacgccttttctgggctgatgtggaactacatggcctcttattctcctctttttggattggtattgcaataaggtaaaatgatggctagggaacatgatttactaagaagaagaatattaaacatatttactattttcaaatatgatcctgttacatctgagtttatactccatacagcattttatgtacaatatttcctacaatattgtcacaaacattacaaacctaacaataagcttttattcactttgtttaacttattatttgctgatgatgctttactcactccctctgggaaggtctgccttctttcccaatcgtatgtggacatctttacaaggcaattcgagttcttaaatgtttgtatatcaaattctgtttcttttgaaaataattttatgtcttaggtgatatgtgaatagatttataaagttattaattcaatagcccataatgaacctttgggacatacaccatgacatatttgttcaacaattttaaattatttcttaatattatagattatcgtgatgaagcatattaatcctacagtcttttcatctccctgtagtcttcaattcagcattaatggagagattttcaagcaccacaggacttgatgcagctaacttgaagataagcttttggggagtttcctgttatctttgcacagtggcctttgtgagtaggccctttccatgttgttagattctctctaagaaacacatgtattagaaacactataactgtctctactatgaagatctaatgccactcctttgctcataatgtatgtgctcaactaaaaatgtttctttgacaatgcactaagattcttctaaagcctatagaacatattatcattgcatctatgtaagaataccattcaaaggagcaatgaaacaaaaagttgattctttgaaaagagaaacaaaattgataaactgctagcaaccaagaaaagagaagagacaaaatcagaaatgaaaagaagacttacaagtgataccacagaaaaccaaaatttcatctgtgactattatgaacaactacatgctcacaaaccaaaaaaatcccgaggaaatggctaaattcctggaaacatacaacctcctaagattgaagaaggaaaaaactgaaaacctgaatagaccaataatgagtagcaggattgaatcagtaataaatacatttcccatgaaaaaaaaaagtccaggacctgatggattcatagctgaattccataaaatgaacaaagaagaactaataccaatcttcctgaaactgttccaaataatctgggaggagggacttcttcattcctcatgtaacaaggccagtatcactctgatactaaaaccagacaaagacaaaacaaaacaaaaaaagaaaactacatgccaatatctctgataaacatagacgcaaatatcctcaacaaaatactagcaaatggaattcaagagcacatcaaaaaggtaatacaccatgatcaagtgggttgtacataaggaatggaaggatagttcaacatatgcaaattaataaatgtgatacatcacgaaaatagaatgaaggattaaaaacctcaatagatgcagaaaaatcacttgacatccttttcaataaacggtgctgggaaattagatagccatatgcaggaaaataaaacagaacctgagaggtgaagccagctggacttcctgggtcgagtggggatttggagaacttttctgtcttaaaagaggatcgtaaatcagcgctctgtagctagcaagaggattgtaaaatgcaccaatcaacgctctgtaaaatgcaccaatcagtgctctgtaaaacgcaccaatcagcagtagctaaaagtagccaatcacagggaggattgaaaaaagggcactctgataggacaaaaaccaaacatgggcagggacaaataagggaataaaagctggccacctcagctggcagtggcaatctgcttgggttaccttctatgcgtggaagctgtgttctttcgcttttcacagtgaatcttgctgctgctcactctttgggtccgtgccacctttaaaagctgtaacactcactgtgaaagtctgtgacttcattcttgaagtcagtgagaccaccaacccactggcaggaatcaaatctggacacagacccttatctctcaccatatgcaaaaatcaacttaagatgtattaaagacttaaatgtaagacccaaagctatcaaaatactaaaaaccttgagaaaattcttctggacattggtctaggcaaagaatttatgacttaagacctaaaaggacagggaataaaaccaaaattagacaaatgggacaattaaactaaaaagcttctgcacagcaaaagaaataaccaggtgtgtaaacaggcaataagagaataggagaaaatatttgaaaactatttatcccataggggactaatatccagaatatagaagaagctcaaacgactccctcaacaaacaacaacaacaaaaagcgcaaacaaggccaggcatggtggctcacgtttataatcccagcactttcagaggccaggacgactggaccacttaaggagtttgagacccgcctggccaacatagcgatagcccgtctctactaaaactacaaaaattagccgggcatggtggtgggaacatgtaatcccagctattcgggaggctgagaggcaagaatcccttgaatctgggaggtggaggttgcagtgagccaaagttgcaccattgcactccacattgcactccagccttcgcgacagagggaaactctgtctaaaaaaaaaattaaaaaaaaaaagacaaagaacaaataatgttctttaaaagtggtcaaaggatataaatagacatttttcaaaagaagacacacaaatggccagcatgggcatataaaaaaaatgctcaacactaatcatcagagaaatgtaaattaaaaccataataagatatcatcttcattaaaatggctattattaaaaagataaaatgtctcatctgctatgttggtgaggatatggagaaaaaggaatgtttatatgctgttgatgggaatgtaaattagtacaacctttattgaaaatagagatttcccaaagaactaaaactagaacgactgttcgatcccacaacctcactactgggtatctactcaaaggaaaataaatcaatatatcaaagaggtacctgcactcatgtttcttgcagcactattcacaatagaaaagatatagaatcaacctaagggaccaccagtggatgactggataaagaacatgtggtatatatacctgatagaattctattcagccacaaaaagaatgaaatcacgtattttgcagcaacatggttggaactggaggtcattatcttaagcgaaataagccagatatagaaaaatatcgctcataagtgagtgctaaaaaaagtgtctgcctggatgtagacagtggaatgataggcagtggggactcagaattgtggggggatgatgagaaattactaatgggtacaatctacagcatttgggtgatggataccctaaaagctctgccttgaccactatgtatgtaacaaaattgcacttgttactcataaattcatacaaattaaaaaatatataagacaaatgtaaccatgctttcttcaaaaaaacaaaaacgaggtaatccccattgtagtcccaaagatgggaggagagaggctcatccaagaaggccagagagggctggatgtaccctgcttccaaatctgctgtctctcccacaccccttacaacagaccctttgctctcccttctacctccccgttctcagaggcttccctttctctatttctcatctgtcccctaaaaaggaaggcagaagattccaattccttgtacccttaggtacttggagcagaatgaagtaaatttagtgaatcatttgcaactctgtacttcttgggtgcacttcaaatatcaacaagaacatttattctgtggaatagactggtttaatttcggccttttacctcaactttcagccgtctgaaattgtgtagacttttccaaactgtgttcatgtgccaccctgacctactgcctatccctgcaattggatgggccttaagaacccagctccaggccaggcgtggtggctcatgcctgtaatcccagcactttgggaggcagagacaggtggatcacctgtggtcaggagttccagaccagcctggccaacacagtgaaaccccctctctactaaaaatgcaaaaacgagctgggtgtgctggcaggcaggcacctgtaatcccagctagtcaggaggctgaggcaggagaatcgcttcaacccaggaggcagaggttgcagtgagcggagatcataccactgcactccagcctggacaacagagcaagactccatctcagaaaaaaagaacccagctccagacactgctccctgatgaacccagctccagacactgctccctgatgtctatgcatccaagaggtgccttcttcccagcagctatcgctctagtggaacaaagcaccaggtttcttctctaattacttctatcagtaaataatttccaggcacctaagagtttagatttagccatgtctttgaggactgtaatttttccctaatttgtgctttctgtaataataattagggatttattgcttatattaaaaactcatcagaactctaattgaaaaggttaactacttctcatgagttcaagttgggaattactattcaaattcactgacaacttaaaatgtaagataattttctttcctaccgtgcaggtccttcatgtgataaggattttacttttgccaaacagaagttcctagaacatcctgggaatatggcattttagaagaaaaacaataagcaattacttaaagcgaatttaacattcagaacaaaacagtgtttcatttgattgatacatattttgtttttaccttgaagaacgtaccacaaaagaagggtcacagcaatgagatataacttcacttaacttttcaaactgatactgtccaaatatttaataatattctgttgattaacacagtgcttttaaaactatggataggaaaagcatatttcttgtagttatatgtcttggaataatatataaatcacacatcagccttaaatattactgcttagcagaagacaatcataaaaagaattttatcaatttaaattagaatactaaataatccagtaaagctagcatttgcagaacacttggtgtgttacacataaatattcaattaattcacagaaaaatcacaagagattgtcagttgcataatgtcactttgctagttaaggtggtacagagatttaaacccaagcccagatgcacaaccacatcagcatagagacagatgttattgcatgttggcagatgaaattgtgaaagtgaaattcccatggttccaaatcagaaattgctgccttagggcgtggggaggaggtgacagtcatttagacggctggtgggaaaattttaaaaataacacaagagggataattggcaatgtcatacaaataaataaatgacaacttttctgagtggaagaaggcaatccacaaggaggctggtgggttactataagtccactttcatattcattattttcttttcttcttcttcttcttctttttttttttttttttgagatggagtcttgcttgtcacccaggctggagtacagtggtgcgatcttggctccctgcaacctccacttccccggttcaagcgattctcttgcttcagcctactgagtagctgggactacaggcgcctgccaccacgcctggctatttttgtatttttttttttagtttcaccatattggccaggctggtctcgaactcctgaccttgtgatccgcctgctttggcctcccaaagtgctgggattacaggcatgagccaccaagaccggccatattcattcttttctaaatggtgattcttatgagaaatactcatatcccccactaaatggagatgttaattgtatcaatttttataacagtgaaatagtacaggtccagttctccagcaataggtggctgactaagcaaataatagtgcctccatgccccagaataacatgcagccatgaaaaaataaggtcatatttactgataacgttaatatatattgccttttaaaaaggcaagatacagaatagtgtgcatattgtgctctgtgaataaaaagttactacaataggtttgttttactcagctctttttaatctctgggaaagcttggagccacagaactaatgtcaggaatgttcgtttggtcagtgattaagattgtattctctatggcccaggcagtgggtcaggatgtaccaggctgacagcattgtttaaacatgaaaattcatgaagtgtacctggtgcctgtttggcatctgcaacttggctggttgggtagctgtgtgatcagcagcctttaagaactctggattctgagatttgagtggactttttttgttgtttgtttgagacagagtttcgctctggtcgcccaggctggagagcaatggcgtgatctcggctcactgcaagctcagcctcctgaattcaagcaattctcctgcctcagcctccctagtagctgggattacaggtgcccgtcatcacgcccggctaattttttgtatgtttagaagagacgggatttcgccatgttgggcaggctggtcactaatgagcggactttctgaggtggagatgcctgacacacatctccgcagtttgcagccagaaagggcgtgtctgcacaattcccgcgagagagggaacgtggaaacctgggcctgacctctctagtctttgcttatgcatgcctgtgtctcacagttcctgcacagtatcctttgcagtaatatatcttagctgtaagcataactttttgacttatatgagtccttccggtgaatcactgagcaaatcatgaccatgatgtagtcgtgggaaccccaaaatatgttctcagttgaaatttccaaaaaagatttatacatatacatgcatataaaggtacaggattatttctggaaggatcttcaagaaattagtgttccctgatccccaagtgagagagccagtggtgtgaagtgaatgactttttttttactccatatatgtgtttcttttcattgatatgagataatttaaagtatatttgtaaaaaatatatagtagttatactcaatgctttgccatgaccatggagttgttgtcttgaggtaagatgtgaaggatctttaagttgcagtggagaataggagagagtagaaagccatgagtgtgctactggggcttccctgaacctgcaggtgagagccagactcttctgaccttttggatgagatcaagaaggcaggcagaaacaggaaaagggtctctgatagaacagcatgtgtgggaaagcatctatacagtgggtttataagaaagataacaggaatccctcatacattgtatgatgtttataaccttgtaacatttattaatggtataaatataaatataacaattttagttttgcacctttgttttgctagtaactgacaaggaacccacagttgttcatttgttcaatggttttgcagcacttgtgactgtctgtcaccttgttgtgactcttctatgtcatgtggacagagcagcaggccgagagccagaagacatggtactactcatgaaggggtcttaacaagaacatttccaacagctagtcacgcaacatgcatgagattcttttactttggttgaaaaatgagggttatggtggaatcgtgttgggcctgagtgatccctaattctctcctgctttttaaattgcatgtttctgctgcaatctcataaagaagaggaaatagcttcactttgccaactgaggaaataatggttcaggtattaagttcccaccaaattcacatttacaacggccacattttacagaattgcatattttagatttttggtgccatcctgatgtttatcaatacagaaggttggcaaagaataatgtttcaatgcactaaaaaaagagaatctgatatggtttgaatgaatggggttaaggtcactatatcttatgaatgaacccagtgatagtctccatagttagatagtattggataatttattatcttaaaaagtatgtggctgggtgcagtggctcaagcctgtaatcccagcactttgggaggctgaggcgggcggatcacgaggtcaggagatcgagaccatcctggctaacacagtgaaaccccgtctctactaaaaatacaaaaaattagccgggcgtggtggcgggcgtctgtagtcccagctacttgggaggctgaggcaggagaatggcatgaagccagtaggcggaggttgcactgagccgagatcacaccactgcactccagcctggcgacagagatagactccatctaaaaaaaaaaaaaaaaaaatccttaaagatagtaccatcctggctgggcgcggtggctcacgccagtaattccagcattttgggaggtcaaggcaggcggatcacgaggtcaggagatcgagaccatcctggataacgcggtgaaaccccgtctctactaaaaatacaaaaaaaaaaaaaaattagccaggcgtggtggtgggcgtctgtagtccctactactcgggaggctgaggcaggagaatggcgagaacccgggaggcggagcttgcagtgagcctagattgcaccactgcactccagcctgggcgacagagcgagactccatctcaaaaaaaaaaaaaaaaagatggtaccatcctaggtcatgagaagttccaagtaggtccatggcatgggtgctgaaaaggagcaacagtgaaggtcatttacacatgaaggaattgcaagttcctagcacttaagtgtcatccacaaggaaattgaagattgaggaattgagaagatggtgatggatgtaagaaaatgatccatttggaagatgacacttgctagaaatggtagaggttgctgtaatcagctgatatttgtctaaaaggataagtgagattgtcattttgtttgcttgcttgctttttttttttttttttttttttgagactgagtctcgctgcatcgcccaagctggagtgcagtggcccgatctcggctcactgcaagctccgcttcccaggttcacgccattctcctgcatcagcctcctgagtagctgggactacaggcgcccgccaccaagcctggctaatatttttttgtatttttagtagagacagggtttcaccgtgttagccaggatggtctcaatctcctgacctcataatctgcccgcctcggcctcccaaagtgctgggattgcaggcttgagccacggcgcctagcctacttgcttctttttatgaacaccagtaaccaggaattgatggaaatttaccagaaatgtttcctgatgctatggtagacaaactatggaaataatgagttctacaagggcattgcaaatggtggtctaggcttcagtggagttgaggatgtatagtcaaccctttttttgttgttttattatttttttgtgtgccaggtattagcctgtgcattttatgggcatcatcttatttaatcttcacaatggataccttcattttacagtggaagatactgaagttcagagacattaagtgacttgttaaggcttgtgactggtaaatggtggagtctgcattagaaatccagactgttgcttccaagccatactctcaaacgctatgctatacaagggcattctgtgatgatgttgagatagtcctttttgaaaatgtaatgagttcccagagggcacagaaggaaagagctggaaggcaggaccacagtgaaagggtgagctagaagaatagaggtgcttagagtagaagaaaagacagacttactaaggggtttgggacttgacagagcacccaaaaatggcagagcagagaaatatgggggaggattatgggccttgaggttcagagtggacccttgcagggatggggcttcagtctccacccctgctcatgcccttgcttcctggaaacctatcatgggctttgctcaggttaccccaggactccagaagttttatgcttcttggagtctgtcttctgagtaggagtgggaatgtagatgtggcaaagctgttctcactccagtttggatgccaggtggtaagaagtttaatttttctgcaaagtttatgcccttgatttatgaaggggtattgatgtttctcaaactaaggaacccaaaccttttttacgtggtgtaaggacattacatgctgaaaacttgatttttgctttggttccactattaatttgctgggtgactttcggcaggtcacagcttctttgagtacctggtttcctttttttaagctcagaaattcagctgcgtgacctttaagatttcatatgctcgccaggcgcagtggctcacgcctgtaatcccagcactttgggaggccgaggtgggtggatcacgaggtcaggagatcgagaccatcctggctaacatggtgaaaccccgtctctactaaaaatacaaaaaattagctgggcgtggtggcaggcacctgtagtcccagctacttaggaggcaggagaatggcgtgaacccgggaggcagagcttgcagtgagtcgggattgcgccactgcactccagcctgggcgacagagcaagactccatctcaaacaaacaaacaaacaaacaaacaaacaaaatatgtaatatgctctgaagttttgccgacatgaaatttcttccttcacaacctgtaccccagccctaggcatcattgttcctgttctgtaccactgcatagaacaagctgcctcctaatttagtgaatgaacacactgcattgatttcatggcaggggatggtgatgttgattactccagattagttctcacttgtgactcctcagatggcagacaaggctgaagctgtcagaaagcttctgcacctctatacctggcacctggaatgctatggattgaagagctaggagctggtcaggtaacttggtctccacacagcctctccatgtgacaagcttgaggttcctcacagtatgacagtcttgggctagtcagagtttttgtagagagcttggctttccccagattcccctgcattccacgagacccaggcaaaagctaaaaagcttcttatgtcctaatcttggaatctgcaaatgcagattcatgggggcacagaaatagataccacctctcaatgggcgaatgacctgatagaaaagaagggaagaaaggagcggccactttgcaggcaagttcatagtcattctgtcttaataaacctcatcccaggttgctaattccaaacaaatttcccagacctaaacatacaaagaggaaggagaaagcaatttaccattcataaatagattgaaattaacgttaatacttacatcttcattttattccatgcccgaaggtagaataatttaataatgttaattattttttccagtcatgacttgctgagccaattaatttttttcatttattttctcatttattctttcttcagggtttgaattggctttgttttctgctttttcatatcttgattttagccatattcaatccaattacagttttctttcagtttttactttctttttattgtcaacactttgcttctttgtatattgaatttcccacccttaatgcaaggatgtctagtcagtagctgctagaggtgtaactactgatttattttttcttctgtatggagccagtgtcaagctagtctagtagtcagtctcctaagaaactttattatctctttcagcttcactggctgtattcgctgggaagcagtttaacgacactggctgatcttaacaggttgctataaccacttgaaggcacaataaatgtgggaggaaaatgttctttttcttctctcttggtggaaaaatagatgtataattttctagctttcttttctccatttgggttaatgatatgaagaagatttctgctagtttaagtgtaattaaaagagagagattggtaacctctggataacggtgggcattttgaggattgcactgtgtagagctgatgatgaaagagcttctctagctaatatgtgctcaaacacacagtgacaagaactagaatgacaaaatccaggctgtatgcttctgaatggtatggatgatgagtggatttttcaccacctggtatgaacataggatgttaggtggagacagacagcagatacctttgggtatctgggaaacttatacctcctgctgtgatggcgatgaagcactcaggccttttgtgttatagaattgggatttgtggtaggcaggattctaaagatggcgctcccaaggcgatatcccatccacctggcatacaaaccctgcctaaccccgggaaccatgaatataatgtgtttgactcctgtaattaggtcatttgtatggcacaattgtcactaagatagggatattatttgagtgcattgacttaatcagaggtgcacctgacttaatcagaactttgaagaagtcggagaggtgagaagcctgagagagttgatgatgcgagagtttctctgctgctgagatgcaaggccgcgtggggaggccttgagaggaatctctggaagctgagaggggtctgcagctggcagctaggaagatggtgcatactgagtcatacaatcacaaggaaacaaattctgctgataacctgaggggtcttggaagcagctctttccctggctgagcctccaagatgagaatgtatccaggcaacatcttgattccaacctcacgagaccccaagcagactcccatggatcgggagacatatgacataataaatgcatatcattttaagccagtgagtctgtggcaaaatttgcagcaacagaaaataaacacagcaaccaccccatttatgaaaatgcaccttagaatttaattttcataatttcatagagattctgcgaatgtttttgtatcatgaaagtgattcagctgttctcactccagtttggagactttaggggagaattcctatactgtaacttatgtttcgaaatattctgatgggcacgtttgagctctgtaagttcttcctgccttatttccagctgtgtttcacagtgattgcacagacttcggtccctgcaggattggccttactattgcagaaagaaaaacaccagattcaaaaactgtcacatgacaatgataacaaggtgccttcgagatgcaatgtggtcaggagtctcacgtataaaaaggatccattcattgactctttataattggagattcttctacaaaatgcttcagttttctcccactgatgagtggtgtctgtttctctggagagtgcttggagaaagacaatgtggagtactgtggaatattgatggatgttgtacgtttatagctaaagcaaccttccctcatgccaccagcatcaggcagttcatatcataagaccaagcacagaacttattttttcttcatgttttctcccaacaccgaggctttttcttctgctatgctcctctgtcacctagctctgcaacttccccaacttcttgcaccctcttagtccctgttctctctatgaccccgcctcatcacttctccacaataacttcctcatacaattttcatgagggtaacctagaagagtgacaggtacccaaagcatatactttatgctgagcatttgatgtcatccaatgtcctttccaaaaggaaccatttctgctaggttggtattctccaaagcccaaaagtccttagaagtgccccatagtgcctgggcgtggtggctcatgcctgtaattgcagcactttgggaggccgaggtgggcagatcacttgaggtcaggagttcaagaccagcctggccaacacagtgaaacaccatctctgctaaaagtatgaaaattggccgggcgcgatggctcacgcctgtaatcccagcactatgggaggccgaggcaggtggatcacgaggtcaggagattgagaccatcctggctaacatggtgaaaccccgtctctactaaaaatacaaaaaaaaattagccgggcatggtgacaggcatctgtagtcccagctactcgggaggctgaggcaggagaatggtgtgaaccggggaggcagagcttgcagagacccgagatcatgccactgcactccagcctgggtgacagagcaagactccgtctcaaaaaaacaaacaaataaaaaaaacaacgaaaattagctgggtgtggtggcatatgcctgtaatcccagctactcaggaggctgaggcacgagaatcgcttgaacccaggaggtggaggttgcagtgagccgaggttgcaccactgcactccagcctgggtgacagagcaaaactcaaccgcaacaaaaaaagaagtgctccatagtgtccgtagtagcggctgaagtgagttgtgaagactgagctcttatggagcagcctctcaggccctcaggccccatgagcccaaatctctttctgggagattcgaagagatgcacaggtcactccaccaggtaatggggcaggtccaataaactgtaacctcatgcaaccagcaatgcctgagaagtgggttctgaaagggctcagcaatctcatgtagcctctccaggactctctcaccttccttcacagtaagtcctttgtgagtcaggctcatataaggagaatgtgactttccttacctcagctcttcacacctatggacatctttaattgttactgcaaattgaccacaactttgttgtaactgtagcaatttgcaaaagaagtgtatgtgtgttgggtgatgggtgggtgacgggcacctggttttgcaccaggaaataaaataatttgcaatttcaggtctttaaagaatgttgagtctatgatagtccgagtgacgcacagacgttagcccagaaagactgtggcagacctctgatttacagagctgtaagatggagtgtttcctggcctcctttgccacgcattatttcctcccttttctgaacttcccggcatgaggtttgcctacatgcctatgtcaggcactgagttgtgacaatcctgaaagtgaggtccctgtctctctatgcctagtatgctatctcaccaaagtcagtctttcgaaagtatgtgaggatttattgcattccagttaaaagcagctgcctcattatatgaaatctttttaatttattctttgtttgtttgtttgtttgtttattgagacagagtctcgctgtgttgcccaggctggagtgcagtggcacaatctcggctcactgcaacttccgcctcccatgttcaagcgattcacctgctttggtctcccaagtagctgagactacaggcgtgccccactatgcccagctaattttttgtatttttagtagagatggggtgttacaatgttggccaggatggtctcaaactcctgacctcaggtgatccgcccacctcagcctcccaaagtgctgggatcacaggcgtgagccactgagccgggccccattataccaaatcttaaaacagataattccctgtgtatagagcatattgcagctatgctcaggggagatgatattcctagcactaaattaccttttttgaactattgagtaaatgtagtctcaacagtgcaatgcttaaagacaaacactattttttatttcttgcaaaataatattttattcacaaaatatccattataaggctgaagagttcaatgatatccatatggtgaaatatgtaaacaaacaaatctttatagttgctaagagcttagcgatgcatttacatgctcttccagcctattggcatttaacctgcattaatcacttttgaataattaatactatgatctcccattgttcattcaactcaataaggtgaaactttaaaaaccacactgattaagatcttccaacttgaaaacctctattcttttctctatgttagtttgctaagaatgtgagctactagtttttaaagaaatatagttctagacagaaatagaatagagattgcacacattcataaatttgtctgactcctaacaagagtaccttgtcaagggtaatatggcttatgtgttagaaatataatttaaaattaataaaataccaattttatcacattatggtaatgtttactgctttcctgaagtgtttgagattttcctgtagaatgtacttggagcatgtacagttacacaatgaaagtaataaactattaaatcaaaaaaatattttagaaacactcagtatatgaacctcttgctctagcataaactatttatatgttttacatccggtgttaggacataggcatttttcttacagaaattctcaaataaggacaaaacatccccctaatatgtagtagaatgtttactgcagcactgtttgtaataataatttctaaaaacctgacaactctctagaatgttatcagtgagggatagaaaaatcattctgaatccttgctatctagcagggtgcagctgtgagaaagtaggagagaaacctagctacggcgtgacacggagagatcaccaagacagaaatgacatgagagaagaaaggaagtcagataataatgcataaagtaatattccattgatgctagaatgcagccagacaacacagtgtgtttagagaaatttactagctaaacttagacattgtttgaaacttttataaaaatgcatttgtggtctacaaatatgtacattagtaaaaataaaacagcacttattgtgcatgcacactcagtgcatctctctgaagtgagaactcataattttccagatgaggaaactcaggcacaatgaggttaagggatttcacccagagcccacgttcagtgagcagggagctttgtaaggctctggagtctttgttcttaatcattgttgctgtattatgctttgagtaatgaaaacaaatcaactcaggagttttaaccaaaaacatctgttaaagaaaatgaggaggccgggcacggtggctcacaccagtaatcccaacgctttgggaggccgaggcggacagatcacaaggtcgggagactgagaccatcttggctaacacggtgaaaccccgtctgtactaaaaatacaaaaaacaaaaaaaaaatttagccaggtgtggtggcacacatctgtagccccagctactcgggaggccaaggcaggagaatcgcttgaacccgggaggtggaggttgcagtgagccgagatcacgccactgcactccagcctgggtgacagagcgagactttgtctcaggggggaaagaaaagaggagattggatcaggtgaggtctaagatctcttaagcaattacatcttacaggagtgtgagctttggggtcagctggctttgggtgagactccagttttgatgctgacacttgactgtgggcagttaactaagtcccactgagctggtttcgaacccataaaatgtaaagtgtaggcactgctttatggggttactgtagtgagaggggctggtcctgaggcaacctggggatagttcctagcaagtgctcaggaataatatcactttcccccatgactccaaaatcccaggatctttagtcttacctgaatatgtatggagtaaaacatattcccaagttatgagatctctctggagctcagtctttcatatcaaactgctaaccagacacctccacttgcatgagccacggaccattaatactcagtctatttgtttgtttgtttgtttgtttgtttgagacggaatcacccaggctggagtgcagtgacacaatcttggctcactgcaaccttcgcaacttctgtctcctgggttctagcgattctcctgcctcagcctcagagtagctgggattacaggtgaggtgcctccgtgcccggctaatttttgtatttttagtagagacggggtttcaccatattggccaggctggtctcgaactcctaacgtcaggtgatccacccccacgccccctcggcctcccaaagtgcccggattacaggcgtgcaatactcagtctgtttgaaaccagtattacctcctttgttctcgtccaaagctgtcttattctctagcgtcccctatcttgacagcaacatcctatcagttgctaaaacacatattccagactgttgacgctcagtggcactctaagccctgtggatgccacattcttaatacattttgaatgtgcccactcttctctgtctggatgactggcatcttgcttagggtgccatcatccttggcataagtttctgcatcctatgtacgccacctgcctcaagtcctaatcccttcatgttggaattacactgcagtcaggggtatccttccaaaatgtacaccagattctctgaaaaataatctgtcttgctcttaaatgtgcccctcagatactgtaagagctcctccttgcctttggattaaatcccaaattctttatgcccgagttgatcttcaatgtcatctcatattccatgccccttccagactcggaagcagttcatggagcagaatattcaactattcagaaacactgaatcaattttcgctctgaacaagaatgatttttctagcttcatgggctctgcccacaccacctcagacacctgccacattccctttacacccacctatcatttccttactacctgattcttttcattctccagatctcagtaaagaagtcgcttgctttctgctaattttcctaacatctccacatctccatctcatgttcaagacaaaggaggttctcatgtcttcccataatgaactatctcgtactgtccccatcatggcagagcatgctgtattacaagttcgatgtgcaggaaatagggcccaagtggtgtttgccattaatcaatgtggcatatgcagtgcagtactggggcagactcctataaatgaccttttaaaagatgctaacatgacctttcaaaagatgcaaatctgactttatcactttcctgcaagacctttgagcagctttgaacctctttgtctttgtttcctccaaagacaccatccagctccctgtgcagcctcaggcctcagtgacttagcccccgcctttttttttttttttttttttttttttttttttttttttgtgagatggagtctcgctctgtcacccaggctggagtgcagtggtgccatctcggctcactgcaagctccgccttccgggttcacgccattctcctgcctcagtctcccgagtagctgggactacaggcgcccaccactacgcccggctaatttttttgtatttttagtagagacggggtttcaccacgttagccaggatggtctcgatctgatgaccttgtgatccacccgcctcggcctcccaaagtgctaggattacaggcgtgagccaccgcgcccggcccagcccccgcctttctgacttccactctcatcctccatccgtctctggtataaagttctttcctgacacaaggtctttgcttatgtggtctcccctccccctctctggatttctttcctggctacaaatcatcatttaggtctcagcttaaatgccacttcctgaaaaatgactttgctgagagcctcaattgggtctctcagttctaaaaaccctgcacgttcccatgtctgtgtgtcccccgatgtgctcttcccaattagacagcagggtccccgagtgctgaattttcttcactgctaccacgccaacacctaacaaagaacttgccccaaaatctatttgtcaaatggaagaataaatcattaaggaaaatatctgatcagtgatttgatgataaaaaatacagtatataatgaatacctagaagtttattatagttaaatgggccgtctctgagatggaataacttcactacgatttatgtgttttagaaaaataatgacatataattcacagatttaatgacagtgtcacatctatacttccattttatgtggcatattgtagaaagagcgagttttattatccagattacctaataaggaaacagtgtttaaatgctgatatggtttggctgcgtccccagtgattcaaagaccaaaagggtttaaataaaaagaagaccaaaggaaataaatagaaaagaggagggaatttatgagaaaccattttaaatggtccattttcaaggcatgataaatcaaaagtactggaagccagcctgcaaatttaacaaaccgcactgctcatgcacctagaaggtcacagtaagcaaacaatgaaaaggaggggtcagcccataaaagggaaaaaagtttcattattgggaaattgaaacaagcaagaaagaggaccgagatataaccttataagggggataatgaaacgtaggtgacatccaggaaaattgtaaccccatagcactcaaccaatgaggaacttggggagggacttgcgtactagaagataaattacttgttgtgactgccccagatgtacctacctaccagacacccaatcttgcaagaccattattaagtctcactttcgcttttcttcatgcctctaagtccattctttgggtttggatggatgagtagatttctcacacccactcaaatctcatcttgaatttctacgtgtcgtgggagggacctggtgtgaggtaattgaatcatgcaggcaggtatttcccatgctatctgtgtgataggaacggtgtctcttgcacacagatggtactaacttcaactatgtcaaacaaaaagttgtttgttacttaacagtcatctcatttgctactataccttcaagaataagccactgattcaatttatctaaaattatgatgttaaaataatttttgaagtttgtttttacatatatctgattatctacctacctctattttattttaccaagttaattgcttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaatttttttttgtatttttagtagagacggggtttcaccgttttagccgggatggtctcgatctcctgacctcgtgatccgcccgcctcggcctcccaaagtgctgggattacaggcgtgagccaccgcgcccggccaagttaattgcttttaacttcaatgttcttaaaatcactctgcctcctttgcattatggtataaaaatagaacaatctttttcctattgatttctaaatgcttgaagtctcctctccttctctttaaaacccaatctgatagtgtggatttaacatgcctaccttcaacattttgttatttgtattaagttatttcactttattattttttaaattatatgccttataagtcaggtttggacttttactcctggttgggaattcttaaataaaataaagagtgattagttgtcaaagtttacttcaagcatagctaagaaaatttggcccatagttctttcctcttgttgctataagatctgtgttttggccgggcgcggtggctcacgcctgtaatcccagcactttgggaggccaaggcaggcggatcacgaggtcaggagatcgagaccatcctggctaacacagtgtaaccccatctctacaaaaaaaaaaaaaattagccgggcgaggtggcgggcgcctgtagtcctagctactcgggcggctgaggcaggagaatggcgtgaaccccggggggcggagcctgcagtgagcagcgatcgggccactgcactccagcctgggcaacagcgagactccgtctcaaaaaaaaaaaaaaaaaaaaaaagatctgtgttttatctatcaagaagtgtttctcattttcaatctacgagtcatgattaaggaattaatagaagaacacccaatgtccttgttcaacaggaattatcagggttaagtcaaattcttataactcagcggttaattactcaatttttgcattttgttatataaatttttacccggtctactttgcaagtagtttcaaataactacttgcaaagtagtcactagctgttatcaatctattcatgatttgccatggtaatttcttcctatcactcatctcttctgcattgctgagtaaaggaaacagtgatcaacttaaagcatgtggaaaacaaaataaatagagactgagagaaaaacagcaaattttacttgtgtatttagtattttcttcctttctgtggcttgattttatttgatgtttggaacacaatctatttctaaaatttgtggggacagttccatcttttggtttctgtgtttgcatttccacctcacttccttaaattaattttcttccataatatttcatgttaacatatatctaggttttgtgatcacacacaaacacacacaaagacacacacagctcttcttgaagtttgtacaccatttacaccatttctctggactgttgagtctattatgattgtttacattgagggatgaatttttgaagacatatgaattgaaacaaaggtcagtggaccaattcagtgtcttgcaaagttgtttattataatgagattattatcagggctttaagccttttaggccatgaggaacaattaatggcactccaaatttacattgagtaaattaatatttgtaatactttatatatcttttgccccccaaaataaaataatatagtattaaatcaactcaagagaaaattttaggaaacaacatgtttatagtagacagaattataagatacctcctcccactgcccatgggcaagattttttaccctgttgtatacacacctactcccagtttttcaaacactgatatagatactgctgtgaagagattttgctgatgtaattaaggtcctgattcactgataaggagattatctggatggaccctaacatggggagatttttctaatcatatgagtccttacaaagcagaaaattttctccagctgatgtcaaaagaggaagtcagagattcaaaacacaagaagaatttgacatgctattgcagttttgaagtaatacagtatcctctaggatgtgacagtggcctcagtggacagccagtgagcaaacaggatcccagttctacaaccacaaggaattggattctctcaattgtgctgataagctggaagcagattcttccttgctcagtcctccagatgaaaacagcccacagcagtttgatttcagctttgtgagatgatgagcagagaacccaagcaagccacaccagatttcttttttttttctttctttctttttttttttttttttttttttgagacagagtttcactcttgttgcccaggctggagtgcaatggcacgatctcagctcactgcaacctctgcctcctgggttcaagcaattctcctaccttagcctcccaagtacctgggattacaggcacccgccaccacgcccagctgatttttgtatttttagtagagatagggtttcaccactttggccaggctggtcttgaactcctgacctcaggagatccacctgcctcggcctcccaaagtgctaggattacaggtgtgagccactgcaactggcctcaccacaccagatttctatcctacaaaactatgaatttataaatggcttagttggaacctgctaaatttgtagtaattggcagtacagcaacagaaaacaaagacagattttataattgagactaggagtggcttcataattaggcagtggaaggaagacagaagaaaatgaggaatatgactcagaaaccctaagttacctcagacaacacctaaattgttgtgcccaggcaactaaaactgtgagataatagattcgtattattttaagcagctgaatttatggtaattcattatgcagcaacagaaaatgaagacagcgcctataatatgtgagactaatacttcattgtaacatgaagcatttcatgctacaaagtactcagatgctggacaaattatgacatataaatcttaaaagatattgatgagcttccaatccagtaattataagctccacccacctactcactctagggacttgatatggtttggctgtgtccccaccgaaatctcatcttgaattcccatattttgtgggagagacctggtgggaggtaattgaatcatgggggcaaatctttcccatgctgttatcgtgatagtgaataagtcttacacgatctgatggttttaaaaagaggagttcctcatggacacacggaggggaacatcacacacccagggcctgtcatggttgggggaaaggggagggagagcattagaataaatacctaatgcatgcagggcttaaaaacctagatgacaggttgataggtgaagcaaaacatcatgagacatgtatacctatgtaacgaaactgcatgttctgcacatgtatcccagaacttaaaataaaaataaataaataaataaatacatacacatatatgcacaacaaaaataaaaataaagcacaagctctctctctttttgcctgctgccatccatgtaagacgtgacttgctcctccttgccttctgccagggttgcaaggcttccccagccacatgaaactgttaagcccaataaacctttcttttgtaaattgcccagtcttgggtatgcctttatcagcagcgtgaaaacagactaatacagtaaattggtaccagtagagtggggtgctgctgaaaagacatccgaaaatgcggaagcaattttggaactgggtaaaaggcagaggttggaacagtttagagggctcagaagaagacaggaaaatatgggaaagtttgaaacttcccagagacttgttgaatggctttgacaaaaaagctgatagtgatatgaacaataagggccaggctgaggtggtctcagatggagatgagcaacttgttgggaactggagcaaaagtgactcttgttatgttttagcaaagagactggcagcattttgcccctgccctagagatctgtggaactttgaacttcagagagatgatttagattatctgacagaagaaatttctttcttttttttttctgttaaaagaagtgttttgtctcgttttaatatcttatcagctttacagggttacaatcgtcttaaatatttctgaagttaaaatacaatctgcataataatgctattataaaatgtaaactttcagcgttcttttaaatttcaaaatcacaccttttttctggtctttttgtctttttttattttttttcctttcaatacctggatgttctgcaaaaactgaaattgttacaggccaccctgctgcggccagggcaagaaaggctgggcccagccagaggtagagagtagttttatgattcttttatttttaatttttttaaagtctatttttttttcttccattacctaagtttcaggcgtggtccccacatcctctgacaaaccccagagaaactgaaatttcacacgtcacgaatgaaaggctgagtttacgtttgccaagaaaaaaaaatgcaaaagcacaattaggggaaaagagggacaaagtgggtaaaaaaaaaaaaaaaagataaaggaaattcagactgtacagatgcgtgacccttaacgaccccggctctccccagtgccccatgcccaccctcccgcctgtcctgacggccacttaagggtcccactgaagattccagaagctgcctgtcccccaacatctcagagcagggagagcccccgctcggcctcgagtgtggggtccccgcccagtacacagctaaccccacggccccaagagaactcgaacccgtccagggtcctcgtggctgagggaggtgcccgaccccatcccagtctgcataagaggggatgctgagctgcaccccagaaagccaccccaactttaaacccccaccgacaggcagtggcgggagatgggtacggctggggttgaacggggccacctgaggcagggagtaccctctggagaccaaggcttcctgcccagtatccaggaccgggccccacagaccccctgcgaccccctcccatttccacgaccactgccttcagtgatttccttctcctggagtcgccaggccgcccaggacccagccccgtgcccacccaccgcccgccccacctgtccctacaatcatcgaagttaacagcaggcccaagttccctgagttagaatccagtcccacccacagccagggggccggatcgcccacacaggcacgacacgcaggattcccgacacacacacgtgcacacgggagcgcaacacacgcagcccgagagagaccacccagcccacggccctgcgcagcccctccccagacaccgaggcgggcgggtgcaaaggggcccatggccccctccagggccgccagatgcagcaggcaaccaggccccagtggctgctgcagaccctggtgcacgggaggcgggggagaggcaccccaggggctcagattttggcatcaaaagtcagacctgaggtagacagagataagcagcaggcgcttcccccagcgcgggacccaggcgcgggacagcggctccggggagaggagccctggaggccggagggcagacacggacggggtccaggcggttctgcgagtggggcccgattgcgtcttggggcgaaaagacacccccttcccggggtgattgtgctgctacggtgccggccccgggaaggggcagggagaacctagctgcccaccaccccctcctggaaagggggtgtgtgtcaatggccctgagatcagaagaaagtggggtcccgtccccaaagacaaaggaaagtgaaagtcccctcccacagcccgacgggagagtgaacctagactcaggggctcagaagccccccagccccctcccccaggggtctccaaggctatgcggaggttgggcggttgggagtcgggggagttggggagtccccttcctcaccgacccccaatgccggtggcctaacagggctcccagggcccaattagagacccaggcttaccatgggaatagctgagttaatccccaccccaccacaagagaaatgaaagcccggagctcccgtgtaggacgcgacagcccagccggtcaccaggcgggtccaacaaggtccccagaccctgccgagcatttcagactcctgcctttctgctccagcagctccagccaaaataacccccagctcggctgctgtaaacccactttctcctaggctggcagaggggcactgacccacagggttggggggcagcctcccttctcggcctcgatttagtcaccgcacaactcagggagctcgcagccccggcacaaaagcggtcgggagaagaggaagagatagaaggaggagaatgttggggtgtggggtgtgttcagtaagccagggccccgaaatcctcaccctgagctaggtctggcttcacccccactccccagtattgttagtccccaaaagcagcccttttggacaagagaagaatcccaatgagaaggccacattcatccctgagacaggagcctgggggctgtgacaagaaccacccccgccccccaggccccaggccctttttccagcagttgctacgttttagataagatttccaggccgggccgggcgcagtggctcatgactaatcccagcacttcgggaggctgaggagggcggatcacctgaggtcaggagttcgggaccagcctggccaacatgacgaaaccccatctctactaaaaatacaaaaattagctaggcgtggtggcgggtgcctgtaattccagctactccggaggctgaggcaggagagtcgcttgaacccaggaggtggaggttgcagtgagccaagatcgggccacggtactccagcctgggtgacaagagggagactccatctcaaaacaaacaaacaaacaaacaaaacaaaacaaaacaaaaacagaaaaaagaagagctaatgaggaaattaaaagaattgtaagaatctatttagcttagttattcaaattagtttgataatcttaataaagtatataattttccaagaaaatataatttaacaaaatgaatcctataaaaattagaaaagtctaaattgactgacttccatgcaaaagacaaagaaaaatgtcagtccttcagaatattaggtggccactactttctaagagaattgtatcgctcctttaaagagaagtaaattccagtgcagtctatactattccgaagaattgaaaactgataaaagctttctaattcattttatgaaataagtacaacattaaagctaaattacttttaaaagattaaatacaaaaaataaaattacagttacaatctcagttaaccatgcaaaaaattctaatgaaatagaaacagccgattagcagaatctgcttcatgatcgctgcttttagtctagaaatggttggatagtcttatgttaaaatatatgaaataagtttccatttttatttgcagtcgatcaaaatctcaatggagaaaaagtcaaggccttgtctaaaggacaaaagaaattttatgatattgttctgtgtctcaactacctgtttactctttatacagtaagggcagaaaggggtgatacctttccaaagttccccatcagaaaggtcacaaccagtactcctataacaaaaggcagtttaaagaaaagtatagcaaatcaatttaatcaaagttttacatgtcagaagagccttcaaaaatgaagaaccaaagacccagggaaatcatctatttttataggtaggcttcatgaagaagggacagcgatgtggaaatgtgattggacaaaaaggaatgatcccatggtaataggctgagaaagaacccagcaagacctgtcttcctggcctctaagctgcatttatttctcctggtgtgggacacacagtcttcaagggagaaggaaaagaatgacttttctaggttttatgacttgctttggggaagaggggctctagattctgtgacttgccttggggaaaaggaattctggtttcagcttcagagtaatgagaggggagggagacaggagggcaggagaaggtcagcgaccttgcccttgattctgaagcctccagtctcctttagttcaaagtattcagcaggccaaggtgccatctgttggagtattgtgttctgaaccccaacaacatcacttcggaagactgaaatggcagatgttatatgccatggaggataaatattgctattacaatctaacagtaatactagccaagatgaaaaagagaaaagaacataccaaaataacctagactatatctcaaagcaaactttttataattagctaaattgtaaaaatagttctcatataaaataaaaccttactattcttatttaagatactcgtaacacaaagataactgtactgtcataaatgtgacaatattgaaggccctgctccaattgttcttatgttattatgattaataatcacttttaaaaatcacttatatttgacatagagatttttttctattgtgcctaattgttctgtagtgtatgaggagaaactgtccaatcaacagattatttagatgtaatttgatgcttactcattgtgtactcggtaaatgaatttttagaagtacattaacaagatgtgagaaaacacattaaattttcaaaagaaaactacacaaaatagacaagctttttaaaatcatggaagtaaatattttacattatatataatgtgaatgaaattcatacccgtagattcaaatgtttgtgacttttaaaatcaaattaaacaaattgagaaaatatgtaatgccattatattgacttagaacatgtcagttgaaaaatagcttcctattttatttggtttctctggcatctatataaatgtatgtttaaaggacaattacctttccttttccctttttatttctgaagtatgaaagacaatgtgagatttttctgggtaatatgagcttctttgtacatctttttcaggatgccactgatgttgacagctattcttttaaaatactgatattcaacatgacaatgcatgtgacctgccaaggaattgagaagctgaaagtacagtgacatggttatgacagggctgcaaaagacatgacttgtaatgtcatttcaaagctttctctaaaaataagttgaaaaacacaaaatgaatttgccttttattcagccaaaatgagtatctctttacttcagatacctagtttgtattggaagtggtttttgaagattctaaaatgtgtgtgtgtgtgtgtgtgtgtgtgtgtgtgtgtgtgtgtgtgagagagagagagagagagagagacagagagagagagagactgtgactctgctcaggggttacaaatcatttaccttgagtagcatattttctttagtctttgcaactagctgaaggatatcataactttccaatattatcatttcataaaagttgtctttaaataaacaaaaagatggagtagacgttgaccaaatgttttgattatcatatgttttttaaaaaggaaacaaaatggacatttatttgttttcataatgatacgtgtaagataggagcagtaaagagtagggtataagacaaacttctagttggtgtattttagaaaaatgttagctaacaatgggatttaacatattaacctctgatactgaaagggaattccatttctggtggtatgtttttccttaagtgaataggccagagataacctcatactaaagaagtatgtgtatgtataaagcttcatatattttaaacaccttattcagcatcatttttatacttggatagttttcactgtttttctaggatctactgaagtgtttagttttgatgaaagaaagtctatgggtttgatcagaagcccatgagtccaatcaaaggtattatttatttgaaatttaaaaaccatgcaagcggccgggcgcggtggctcacgcctgtaatcccagcactttgggagaccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaccatgcaagcaatttcaagcatgtaaattaactaggattttaggacaacctgtgagtggagaagcacaggaaaactaggttatcagaaattcataggagatcctcctgaggcagaagtaaaattatagttgaggagaaatataagtcatcatcccagattaatttgcttgcaatttgaaattatggaaagaggaaaagtccatgtgcaaggatcttcttttccatgcaatctaatttttaaaaattgggataaaaacagcatgagagctaccctcttaaatttttaggaatacaacacagtgttcttaactacaggcacaatgttgtacatagcagatctctaggacttattcatcttgcatacctgaagctttatacctgttaaacagtaactccctattttccacttctcccagcccctggtaacccactgcactttgtgcttctgtgaatggggttattttatattggacatataataacggactcacactgtattttccttttggcttatttcgcttagcataacgtcatcaaggttcatccatgttgccacatatggaaggatttcatttcagacaataatattttgttgtaagtagatgccacattttccttatctattcatatgtcggtgggtctttatgcggcttctacatcctggctatcgtgagtactgctgcaatgaacatgagagttcgaatatgtcttcaagatcttaattttttgaataaataccaagtgtgggattgctggatcatacgatagttctatttttaatgtttttgaggagcctccatactgttttctatagtggctgcaccattttacactcccaatagagtacaaggattccaacttctccacatctttgctaacacttgttatctttttgttgttgttttgacaaccagtggggagtgatatctcattatggttttgattggcatttctctgattagtgacattgagcatttttcatatgtgtgttggctactcggatattcttttagagaaatgtcaatccaagtactgtacaccttttaaaaatctgggtatttgtttctggctattcagttgtagggtttccttatatatgttggatattaacaccttattagataaatagtttgcaaatattttctcctattttataggttgccttttcaatctattaattgtttcctttgctgtcataaagcttgaaccctttctgggtttaccctacagatatcttgtcattatgaatcttcttaaatgatttcatttttatatgtacaataaaaatcaatgagaattgttaaaaacaaaaacctcagagagataggattttactccacagagaacaaagtggagctcatatcaacctgggattaataaaaagaaaactcttttcactcagataaaactctcaggcaaggcatttggaaatatttttgatgcattcatagtctttgaacaatttaagagtatatttatatcacatgttcttacctacaagtggaagctaaacattaggtacacatgtacacaaaaatgagaacaatagattctggagaatctgaaggacagaaaagagggaaggggcaaagggtgaaaaactacctatcgggtactatgttcactatttgggtgatggattcagttgaaacccaaacctcagcatcatgcaatatatccttgtagcaaacctgcacatgtacccccgctccaaatctacaataaaaaatagaaatctttggcaaaaaaagagtgtatctacagctcttaagggctatgtttatatatctctattgtcttttgctttatattttgtttatattttaacaatttgtgaaataagtacatcttttaatgctctttatatagttctaatgtaacaacatagctacacaccgttctcataaaaacaaggacaggacatttagaggtagcaataatgagcaaaggtaacatttcaatggaaactgagctaaatgagtaaaaacaatacaaatgatatgtaaaggattacaaggttgataggatattgtgttcaagccctagataaatccaaccaactaatctttgagagagaagtatgtagtacggaagcatgtaactgtaattattttgagaaatgctaaacctcaaaataaaaagatttttgcacttgtcataattgaaagtttgtttttcctctctttttggtaacattctatcaccctcgcctgcaaccaaaatgaccctcaccctggcagccagcactgggattccatcctcatcgagctccttgacacgcaggtcggcttcaccgtgggcaagcacaatcatcatttgcagacaaaaggagaacccagttatttgatcttgattataagatgtgacaattatctctcaaatattacagattttatgtcataaattgctctggggcactgcaacctagcaagtcctcctgagaggcccatctagcctgctgcccaggccacaaccaaccttgccactagccttttcatcaatacaaaggacaactatttgtaattgtcctccaattgaaagaacatgcctaaagttgtcaattgtgtttatatattttaggtaggtaagtaaagaaaagttcttgttgttggtgaatcacagacaattgttcaatttagaggagaaggcagcctgggtagtggagaggaggacattgttttcattgttgtgtacccagggcccagcatagagacgggaaaatagttggcatcagataaactactattgaattcaattatcatgagattcctttgctaatgctgagaagtacagaaggtagagaagatagaattttatgcttagggaaataaaagactcagaagggtttgccttattgaaacccacttagatttgaaagtcctttaagataaatatcattgaatttgacctaggtgagcgtttatattaattctaggcttacaggtctagaagaagcctttgtaaagactttgacatgtccgagtaagattgaaagtgccactctgaaacctactccatagcctcacttactttacttactagaaaacatgttgccctcttgttccactcttcaaagtcaaagaccttgtgacttttctgagccctgaggatgaggatgaggtttccatcacttttcaactttgaatatagaacagagcaggatatttgctgtccagtgaacatcaacatatttcagcaagcctcatctttgttctcattgatggaaagcttaaattaaatctttctcagccagaacattcaacaagggatataataaatgaattatgtaaagaaatacgtagatgttttaaacaaaacttctctatggtctcccacaaacctcacacataaatagaaagttaatcatttggtaataaatgaacactttaggtaatgagagatactcaggatccctgaagaaattaaattcttattttctcttttttttttttttttttttttgagatggagtctcactctgttgcccaggctggagtgcagtggcgcgatcttggctcactgcaagctctgcctcctgggttcacgccattcttctgcctcagcctcccgagtagctgggactacaggcacccgccaccacgcctggctaatttttttgtatttttagtagagacagggtttcaccacgttagccaggatggtctcaatctcctgacttcgtgatctgctcacctcggcctcccaaagtgctgggattacaggcatgagccaccgtgcctggtcagattcttattttctcttaaaaagacagcatgtcctgggcacatatggaatgccatgtccaagcacacaccaagctccatccccattaggagtcacaattagcacattgctgttgacaagatcaaacacagacctttcccctttggcctaagtctgctgacaaggcaaaacacagatcctccaaccacccattctttgtctcattattaatcagctaagattagaactgtttgtccctccgaactaacaaaatcctaagataaacatttcctgttgagttgactaagacccccccgattgcagaataattttgatagtaaattataccaccagttaaacagtcacaacctgctgagatctggccatgttctctctattacaaatagtcctaatgaaatcatatgctccacagtccagtgcattttgtctttgagagttgccagcctcttttactggagttgcagctcacgatgtagaggaagctactctggggactttggtcattttgcactttgtaggaattgtgctcagtaagtaattgattcacttatcatgagagataataggcaaataaaaagaattcttatacttttgatggcagctaattgggttcccaggttagtctggcatagtggaaagagggttcctgggttctataggctgcagacatgaacctccacatttgctacttgtttccttcaaggaagtcacttcacctccctaagcctcaggtattcaatttgtgaaatgataggtgctagatttctaatgttaacactgtggagaaaaactccttttcttagtagaaatatcttccgtactcccaaaacacacacactcctgtttctcttcaggaaatgcttctattgacctgttagaataggagctgaaaccccaggtgacaattttgaataacgatataagaggttaatattctactttagatgatggaggttagaagcaagtcagctaactgcagagctgttgttttgctgattggattcaagtagagtgacagatctgagtaccttgggacaaaatgagggcatttctgaggaagcagaagtctgaaagaaaagaaagaggagaagtcatgggaaccaccttctcaaattatagttccttttggctagatacttagttaactagtgtaacagtaaatacaaatggaacataggaaaaaaataataattctccctgatggaaaaagggaaagagatctccaccaccaccaccaccatttcctcagaatattttctttcagaaacataaattctttctctgcttcttagggatatagcaattttttaaagaaaaaagataagtctcttgcaggttttacaatgtaggaatgtgtttctcaagggtctggaactatctctgagatagaatcaccaaggaggattgtacctcatcccctcatctttataaaccaaaaataaaactcatagccaccccctccacccctcacaaacatctgaatggacccctcctctgccagggcaccctaaatttaacctgaaagactggtttaggccatgatggtgagacagccaggtgggagagggtccccagtgaaactgcaaccagcccacactggaaggaatgcaccttggggtggagccacagaagtttgcactgtttgcagagggaggagcctggtcccacctcttcctgtgtggaaactgggattcaatctgcaaggcaggaagcacaccagcagagactctgactttgcagagggtccctgttcccccttttttttccttttcacccaataaaaccctgctttactcacccttcaactcgtctgcaagcctaaattttcgtggccatgggacaaagactgcatctttagctgaactaaggaaaagtcccacaacaatggggagggagggtcagatatgcctcattatgccctctttcctcttggaattcaggaaaagccaatcaccatttaacatcaacacaagccttaggtctgagaagaaacctgtacaatctattttctctgaagcctgcgaaatggaggcttcatcttcatgataaaactttggtctctgcaacctcttatcataacccagacattgttttctatgataataactctttcaagcaattgccaatctgaaatttttcattctacctataacccggacacccccttgctttgagttgtcccacttttctggactgaaccaacttatatcttaaatgtatttgattgatgtctcatgtctccctaaaatgtataaaactaggctgtgctgcaaccaccttggacacatgttctcgggatctcctgagggctgtgtcatgggtcatggtcactcatatttggctcagaataaatttctacaaatgtgttacaaagttggactctttttattgacattttcatgggagggtaggaacctaatgttacctaggcgtcgggctccacattgcaaaactacctcctggtataaagatatgagaatttgtttttcctttggataaaggtaattagcaagcacccatggccaatttcaattacccagtgaatctgggatgaactctatgtggcaagtggtgctgtcaagtccttttacttacttgcaaactacttatcatcgatcttgagaacgtgtatgtgagggttttacctacttggccacatgaaagggtgagatttctgtctgtttttcaatctctttggcagatttcttgtgatgcacattgaagtgagctttagtgcttattcaacaacatctattctacttttgtggagaggtttcctgaacaggttttgttttaaattatttcccaaacactagatatttgctatacttgaggctgcaaagaaggggtcagcaagctttttctgtaaaggcccagatagtaaatatttaggctttatgtgtcacatacagttttaggtcatattattttctttgctgttttttttttttccccagcctgtcattaatgtaaaaaacattcttagcttgttgcccaaatggggactggatttggcccttggctccataatttgccaactgtaaagtgtggaaggagattgtgaaacccttcccagagaggcctgtaaggggcaccttcagagggtgatgctacctttagggaaacaggtgactcagacccagtcttttatttacttccctagccactagagtttggctccatctctgtgccaaaggaatgcagtgaagagagaagagaggtattcaaaggtgacatatacagttgattctcattattcacagtagttatgttctataaagtttctgtaaatatcaaactactgtaggggcagagagaaatcttcccctctgccctctgatagttcactgctgaaatgagctgacaatagacagattaacaagggaaaaatgcatgcaatttattaatatgcacatggagatgggagtcctaaaaatatgagactcaaagaagagctttggttaagccttaaatgccctctagttggttaattcttaaatatcctattcacaggggacagggaaaagggggactgtgggcacatctagagggaaagtaaattattttagggaaaatgaatgagctcaaagaaaatacaattggcctggtacaaagttcgtctgagctctgggggaagtacaagcaaattatggaaaggtgagaccagaacttcattgtaaacaaaggttgtcattatgcagataaaatctttcccataatctctctgagctgccctcagaaggatagatgaaaagtctgtctggacatggtaatgacttattttctcctccctggtggttactctttcctggttatatgataagatctgtagagagggagttttaaaacatctgcatttctggcccggtgcagtggctcacgcctgtaatcccagcactctgggaaggccgaggagggtggatcacgaggtcaggagatcgagaccatcctggctaacacggtaaaaccctgtctcccctaaaaaataccaaaaaattagccgggcgtggtggcgggcacctgtaatcctagctactcgagaggctgaggcaggagaatggtgtgaacctgggaggtggagctagcagtgagctgagattgcgccactgcactccagcctgggtgacagagcgagactccgtctcaaaaaaaaaaaaaaaaaaaacaggccgggcacagtggctcatgcctgtaatcccagcactttgggaggtcgaggtgggtggatcacaaagtcaggagttcgaggccagcctggccaatatggtgaaaccttgtctctactaaaaatacaaaaaaattagccgggcatggtggtacatgcctgtaatcccagctacttgggaggctgaggcaggagaattgcttgaatccaggaggcaaaggttgcagtgagctaagatcacgccactgcattccagcctgggtgacagagagagattccgtctcaaaaaacaaaaacaaacaaacaaaaaaaccctgcatttgtatatgtcaatttgactgggctaaattgaaacaaacaaacaaacaaaaacactgcatttcttctggagaaacctcccttggtcagacttaatcagataaggaaacttcagcaaaagcctctcctttcttgcttccttgcttcaggaaagaaagaggatggtaggtgatatggtttggctacgtccccacacaaatctcatcttgaattgtagctcccataattcccacatgttgtgggaaggacccagtaggaaataattgagtcatggaggctgttccccccatatccccatattgttctcctggaacagaataagtcttatgagagctgatgtttttataaggggaaacctctttcacttggttctcattctttcttgtttgctgccatgtaaggtgtgccttttgccttccactgtgattgtgaggcctcgccggccatgtggaactgtgagtccattaaacctctttttctttatcaattactcagtcttgggtatgtctttatcagcagcatgagaacagactaatacagtagggtggggttgggggggctgatggtgttagacagagtgttggtcctgaggcttatttctgaggcctttcaattttatttaattcaaagcactcaacacgtcaaagtgccatttttgaggatatggttttcagagctccaacattagcaagtattaaattgttgcttcttgggaaaatgtaaggggaagtttctgtgagcctctggctgcaacattttcatcaaatgatcaagacataatcttgttttatatgtgtttctgtttaaagacaccttatttaacatataaaatttattcatcagcattgagattatagccaatggcactatactataggtcatatctgaacaaagattatgtcacatgtgcctccataatgcacatcacggtctttttgtgctttgagagcactttagcactatgtttgggggccattgtaaacatcaaaatcaccaaaaaagcacaaaaatatgaaaaccacgacactaaacagattgtgaaaaggacacttgattttagtatgagagttgaaacaagaaggcagaacacggttttgttcaacatcagctgggaatgtgcaagctgggagaatgaaatttttggccagtctgtgtatgacaacaaaggtgctgtgagtgtgaattttggggttagtaataaattttagcaggtgggtgaatttgcaaatacaaatacattttagcaagaaggtggatttgaaaatacaaaatccacgaataatcagaattgacattctgtgggagttttattgaatgtgaaatgtaaaatctattttctaactattcacaactacttatgaataatgaattcatttccaaatatgtttctgtaaagagtgtatatatgttggggggggtgtccctggaggtgctgagtggaacctccatttgggtgttattgtcacctgacatttcagccccacttttgggttatatcacataatcttaagaatttaaaagaatctaattaaaatatttgtatgttaatgtccatttgaggatattccaggagtaagagtgtgtgtggatttaaaatgtcataattcttggcttggattattacagtcatctattaccatatttagaataatagctatgacaagtttctgcaagtaggtcatgtttgtgctaattgcttgtcaaagctgtatccccaattatcaccaacataacatgttgatgagacaaagttgattgcttatttattgcaaagtttttttgtttttttgagatgaagtttcgctcttgtcacctaggctggagcgcagtggcgcagtctcggctcactgcaacctctgcctcccaggttcaagcgattctcctgtctcagcctcctgagtagctgggattacaggcatgtgacatcatgccgaactaattttttgtagttttagtagaggtggggtttcaccatgttggccaggctagtcttgaactcctgacctcaggtgatccacccgcctcagcctcccaaagtgctgggattataggcatgagccacagcacccggcttattgcgaagtttattgcttacctatgtggcaggaaaataattgacctcccaaagatgtccacacactcatctctggaatatgtgaacatgtgaacttacatgaaaaatggaaattaagaccacatttggaattaaagtggttaactcactttgaaatagggagattatcctggattatccagatggggctaatcacaagttcttaaaagtggaagaggggggcagaagagaaagaaccaaagagatggcagcgtgagaaggcctcccagcctatcattgctgactgtgaagatggaggaaggggccaggggctgaggacagcaggcagcctctagatgctggaaaagtcagacacaggagcccagagcctgcaggaggaacctctaccctgctgatgcctggattttaggtcagtgagacccacattgaatgtctgaccaagaggactgtaggataacaagtctggattgtttacaacactgtttgtggtaatttgttacagcagcaatagaaaactaatacactggcaagggagagagtacagcctttgtaaatttctatcagcatctcagaggagagaaggggagatcagaatttattgagaattgcaagtttggtttaagatgggtctctgaaggagaggatttgattagaattgtgtgagaatcatgatacaacagtctgggcttagagaaaatagtgaggtgaggatttgtggggaaggattcaaagactcaagctgtaaactcggtctatgacttcccctgaaggttgataaagcatttgggaagttcctataatgaaaaatcaaaccattctttaggtaggacagtcctcgaaaagtaatactaatggaacaatagaataacaaagtcatgttaatatcagtgggaaggtgtggcttcggttctcagtgtccaggctgagatggttctcttggttcttgatttaatagctgatcttctatagaaaaatgtatagctgtcactgccctgcttcctctgtgtactaatttatgactatgctcaaaggcacaaaagcaatacaagtatgatctggatagaaaaaaagaagtatttggcagctaactatgaagaaaatagactattctgatggctgctttcattactatcactgtgtacattgctgaaagtagaacgtgagcagaaaataataattttcgaatttaaaacatactttgctgtctacttatgacatgctaataaggtaacaaattcttatcaatcatgtctgaaaaggacacaaatagaacacagtgcttgccattttagtgattgtcagatttcttgtgacaactgagaatgttaattttatagtaaacttgccattactctgtatgtagttcatcatgatgtcttctgaagccctttcagtcatggcctagtgttaaataccaatgcaatgctgctttgatcaatgcaatgcatgcagtgcccataaaactaatgtcttgtaaaactactttgtagccagaaatctttaagacattaccagtattctgagataacacagaatactctctcataatttttaaatctttaaatattaatttcaacatcaaacacaattcattatggtaccactttttttaacatgattaacttgatagctaatacaaatcaatgtgaatgtaaatatataagaaatgacataggtaagacaataaacatctgattacttgctcagcaaatattttcttaccaactttacaaacctctttttttttgcattattttgaaacatttacttttgctagattcagtgaagcaagtaaagtttgaatttgaaaataaactaaactgtgatttgtggaacaggtttttatttcacttttgaaataaatgacacatactgcaattaattaaatttgagataatttgattattagagataatgactttgagcaaatttatcaacatttattataataactcttttaaattaatcgcattgttattcatgtgctatgttaaaccacataatcaaactgaaactttaagaaagtacacaggtcccagaacagagcagtttttcctcaagacaggaaattccggtctacctgagtcagtgcaaaaaggaacttttctctgctttaacccttacaacaaattaacctggattaaccctgatcttaaccaatcagctttttgtctattgttttgtttaattgttctcattttacagaagctaccgttcttccattgtctgtggaagctctcatcctattttgtagaatgcaggctgccctgattcatgacttacaaatagaagccaattacatctataactaaatttgttctaattttgtcttttaaaaaagttatcgtcataggccaggcacagtggctcacacctaaaatcccagcactttggaaggtcaaggcaggcagattgcttgaacccaggagtttgagaccagcctgggcaacatggtgaagcacagcttctacaaaaaataaccagatatgttggcatgtgcctgtaatcccagctactccaaagactgaggtggaagaatcacttgagcccaggaggtcaaggctgcagtgagccatgatcactacagcctgggcaacagggcaagactctgtctcaataaaacaaacaaacaaacaaaaaacagttaacatcataaattttgtttttattaagaaagggcaacttaacactttcttagctcttgaggatgtaaattggttatctaacatatattaatgtctcaaatattgtattatcttttaaaaatatgtttgtgtagaatatggagtgaattaagttaaaatccagataaatattttcattatcttgcaaagtttccaaaatgctatgtgtttttgcatataattatttacaacttatttttaacacattacttcagcctattagggatccaatgacatagcctggatgtttgtctcctaaacctcatgttgaaatttgaacccctgtgttggaggtggggcctaatgggaggtgttagggtcttgggagcagatccctcatgaaaagattgttgccctccccggggagaggggatgaatgagctctctgttagttcccaagaaagctagttgttacaaagagcctagcaccccctcccccctctttcctcttttctcactatgtgatctcactacatgctggcttccctttgccttccgccatgtgtggaagcaacatgagaaattcaccagaagctgagcagatgctgctgccattcttcctgtatgggctgcagaatcatgagccaaataaacctcttttttaaatacattttttagtctcaggagtttttttaatagcaacacaaatgggttaagatattcaatgcaatggttcatgccaaaaaatactttgctatcccatgtcacgttatagacttcaggagaaaggacgtttagaaggcataaagacatttacaaagcacagtagtccctgtttttattaaaacacatcattgctctatctaagtatttgctctggttctgtaagtgactctcccagcacacctctggccttcaggtttattctattttctcagcacagcacagttttgctaatttgtaaaactccaatttctcatgaacataatcagatttctggtttctcataaaaagaaatcatagaagacctggtcacactgggaggcatcccttatagggtaggactatgccctttcaatgagccaggctctgtcctgagagacagcattctctcccagctccatttactccttacctctccttgaaggcttttacctgctatgatctttagcaactctgctgcctttgcttgcaagagaagattaggcatataattaacatttcagtagcagatcaggcagagtcagaatgagggcttttgaaacacatcgcagcattcatttacaagtgattagtggtggccacaggactggctgtcgctgatttgccttgctttagggaagccatttttatcttccctctacttctggctgttggaatgtttccatcttccagcatatggcacttagttcctgaggtttttgctcccaggaaaagagaaagtccccaaacttaattttatcctgggaagagcgcatctaaacctttaattcagagcagatgatcactaatcctagcatagtcagacctaagcaggcaatatttagggacagacaaactttgaaataatagcaactggctattgtatctctactaagaactctgcctcaagcgtagacatggttttctcctataaatctcacccttaggaactgacaatttgtcttaggtcaggatgatattagtttagcactcacaataagtttttctggaaatttagaatggtaacagaagtttatattcttaggaataaatataaactattttcttcctactatgttctgtgtgtcattgtggctggtgaataaagaagggacagacactttgggaggctgaggtgggctattattgttgtgatgaggagtgatgcctatgaaacctttaacatagtgccatatacagtaacaactcagtaatatttagttatttgtattattatgccatctccaagacacctcaccactagtctctagagtatcacaagtaaaactatgtggaatcttccactcactccagtttccactctggcaatcgtgtggtctataaaatatactgtcctctttcagacctggaagtggaaggagcctgcacacatttgaaagaaaattgtccaattaaattcattatctttatgacatagatatatggaaaatggatgtaaatgcaggagatttgtttttaaaagttgaataataaattccgctgaaatacaatgtcattcactatgtaggcaaataacatctacaaaaatttaggtagagggatgtatacatctattaggatattctagaatgactttttaaaggttatgctgtaaaaatgccaccaggtgttagaaatagatcaaactgtgtcaaactttttttttttctttttttttttttgagatggagtctcgctctgtcgcccaggctagagtgcagtggcgcgatcttggctcactgcaagctccacctcccgggttcacgccgttctcctgcctcagcctcccgagtggctgggactacaggcgcctgccaccacacccggctgatttttttgtatttttagtagtggcagggtttcaccgtgttagccaggatggtttctatctcctgacctcgtgatccgccagcctcagcctcccaaagtgctgtgattacaggcgtcagccgctgcgcccggcctcctccatagcccttctaacagaagcaccaaatgacaactctagaagaaacatttacaactctttccatttttcatcatacctttaaattataggatgtcatttgatggtttatttcagtggtctgttgttctacttggtggtctatttcattataaaatatatcttttatgacagtaaaccactggactacagagtcatgataatttctaaattttgctgctgacctctagactcacagtctgtaaatagtctgacttgatatcactcctataaatgttgtcaggttagggtcaagtaaataattagaaaataattcagtatttttttaatcaagcattatgatttttatctttttgcaagtttagagtaactttttctaggacaaatgcttctcttgaccctgacactctctgaagatttgttttgtgtgccaaattgtattactgttcccaattacttgctgtcctccaagtaagaggattatacatccctgacacaatggagttgggattggtcatgtgacttgctgtagcccatagaacatgaagagaaacgctgagagccactgctgtgaagaagcccacattctgcccataatggccagagagcacatcagccataaattaggttgttcagttcatagcctgcctccctccaagcaaacattatggtgataggcagaataatgctaggaatcttaaaggtttggtcattttcttttctcattttcagagctttgtgcacttttgacccatattgtttttaaaactttgccacttaggatagatttacagcaacccataggaaacaaaatttaaaaacaatatataaggcaattatctaagagctataatttttaaattaaaagattttaaaacactaaaaggaatgggaggaaagttctctactaatttattaaatgatgtaaaagaaaatagaccggagaaaaatgactaataacaaatacagcatcctctttcatattttaatattctacatattagatttaatgacgaccaggtatttgagagtatatttattgtcataagttaggcataaatgtatatatagacacattgatacattaaatgcttttgtgtgattgtataccatatctacatttagtttttgtgaactatatgtagttcacatatatatcacatgtcatgcacatatatgtcatgcatgtgacatatatcatacacatacatttaggaaaaaaatttctatgaatgaaaatatatgtgcccatctcctagcttaataaattaaacattacccatatttattagtccccaaggtaaacgctatcctaaattttgtttaacattcctttactttttgtttgtgattctttgaatacactcttttgtttttccctttttttttttttgagatggagtcttgctttgtcgcctaggcgggagtgcagtggcgcaatctcagctcactgcaagctccacctcccgagttcatgccattctcctgcctcagcctcccgagtagctgggactacaggcgcccgccaccacgtctggctaatttttttggttttttagtagaaacagggtttcaccgtgttagccaggatggtcttgatctcctgacctcgtgatccgcccatctcggcctcccaaagtgctgggattacaggcatgagccactgtgcctggcctgtttttcctctttttgaagacttcatagacttggaacatacatattaactctgtgattttttaaaagctattattgttcaacttgagtttttgagattcaggcatgctgatacatgtaattaatgtccttaattttcactgctatatgatattccactgaatgcatctgccacattttattcatccattttttggtttttaggcatcttagttgtttatttttccttttttggctttcataaaaaaatgtttctatgaatattttagtttataacatcttttcccagtgacttttggattttcctattcacaacctatttaactgagtttactggtttgaatagagaactttgggaggcaaccaatgtgacttattttagcagacgggatggtggttgaggtgaactgatgtgcacatgaggtcaggtcagttgtgcacatgggcatagccttttctcagtgataattctgaacagcccagcacattattgctgggaagtcctttagagaacatgggtccaatttcctcttcttgaattgctgtgccaatgcattttcaaaaattactgtcatggctggatgcggtggctcacgcctgtaatcccagcactttgggaggccaaggcgggcggatcacgaggtcaggagatcaagaccatcctggctaacatggtgaaaccccgtctctactaaaaatacaaaaaattagccaggcgtggtggcaggagcctgtaattacagctattcaggaggctgaggcaagagaatggcgtgaacctgggaggcggagcttgcagtgagccgagatggcgccactgcactccagcctgggagaagagagagactccgtctcaaaaaaaaaaaaacaaaaaaaacaacaacctgtcatgttaatgtagtttcctatgagaaacaagtgaattaaagagttaaaaattaatcgtgttacagatgagcttgtttaattgctgcattccttctttttctgtagtgactttatatgagcactgagaggcagaaatggtgatgagggttgagaatttgcggttgttttcttcccaactaacttgtaaatttagaatgacctaaatttaacgacaacagctgcaaactctaatctgagtactatattataatattaactgctgaatgaaactagacattatgtcaacgtaagagcaacattttcagggaagggtgaggaatttggactattttagaaactaaaggaatacagcaggcaaaacaaacaccaatctgctgacgtcagataaagacaaactttatttctgaaaaaagaaacttaggggagaaaagcttagggcaaaccaccagctgatatagtttagatggccaggcgcggtggctcacgcctgtaattcccagcactttgggaggccgaggcgggctgatcacaaggtcagaagatcgagaccatcctggctaacatggtgaaaccccatctctactaaaaatacaaaaattagccgggcatggtggctggcgcctgtagtcccagctactcgggaggctgaggcaggagaatggcgtaaacccgggaggcggagcttgcagtgagccgagatcgtgccactgccctccagcctgggcgagagtacaagactccatctcaaaaaaaaaaaaaaaaaaaaaaaaaaaaaaaaaaaaatatatatatatatatatatatatatatatatatatatatatatagtttggatgtttgttctttccaaatctcatgttaagatgtgattcccatgttggaggtaggccctggtgggaggtgtttgggtcatgggggtggagacctcatgaatggtttgatgccttcctcatagtaacgaataagtcctccctgcattagttcatgcaaaagctggttgtttaaaggagtctaggccgggtacagtggctcacggctgtaatcccagcactttgagaggctgaggccggcggattgattgatcttaggagttcgagaccaccctgggcaacatggtgaaagctcacctctactaaaatacaaaaaagtagccaggcctggtggagtgcacctgtagtcccagctacacgggaggctgaggcacaagaattgcttgagccttggaggcagaggttgcagtgagccaagatcgcaccactgcactccagctggggctacagagtgagactctgtctcaaataaataaataaataaataaataaataaataaatgagtctggcatctctcttgttccctctcttaccatgtcatacaccagctcccactttgccttctgcaatgattgtaagcttcctgtggcctcagcaaaagctgatactgtcattacactttttgtacagcctgcagaactgtgaaccaaataaacctcttttccttataaattatccagcctcacatatttctttatagcaacacaaaatcgactaacacaccagcagacatggtgttcttgttctcaaagccaaggcgggcagatcacctgaggtcaggagttcaagaccagcttggccaacatggcaaaaccccatctctagtaaaaattaaaaaattagccgggtgtggtggtgtgcacctgtaatcgcagctactctggaggctgaggcaggagaattgcttgaacccagcaggtggaggttgctgtgagctgagattgcaccactgcactccagcctgggtgacagagcaagactctatctcaaaaaaaaaattattataatcacaaagtttaatttacagatatgacctgtttgtgcagggacctcacagtccccgtgtctatttacagaatctccagctttgaactcactaagatagggcaacctcagtttcaggtagctggagtggaaaccccatatcacagttctgacttcattgttctttatatctaatcccaggtataccttgtatagaatctgttacaaggtgaggtaagtgaggtactccccttaggaacacaattaaatgggtaagcacaaaacttagcaatcaaaataaataatgttttaatacattatttaaaaatattaaaattaatgcaaaaaagtcaccatgagcaaatattaaaatttagcaggatctgagcctgcacttttgcaactcaccttgttcatctcaccttaattcctgttaatttccttctcaattagtttccagcaggacaaaaattcgttggacttggtatgaagattcaatccataccttgcagaaatatttggtctaagaaggatatttcatctaggacgaggtcatttattaagtttaattctcccatcatgtcttcaaggcaacaaatatagtctaagaccctctatgaccagttttatttgccactttccaattattttgtcactacacagccagtcacaatctgttgtaagattttactacaaatgatgacttaatcttgctatcatgattaggatgattatatagttttcttcattcaaattgggacattctttatttgaaaggagtgctacagaaatcatgccaggactaatgggactgacttggacaaagcagtattgctttcagtatgcgctattatattttaagcacgttcttgtctcatggatgactttattagcataagagtggccacttttaaaaagcagcatttctgggaggctgagggaggagaatggtgtgaacccgggaggcagagcttgcagtgagccaagatcgcaccactgcactccggcctgggtgacagagagagactctgtctcaaaaataaataaataaataaataaaaaataaaaataaaaataagaaagcagcatttcctacatattgcattcaattttttacttacctatccctttgacttttaaaactttttttcttagtctgtgcttgtgtctttgtgatgtttccatcagacagcaggcggcactgcagcgcactgtgcaccgagttttgcattcctgccatccttttatacttatttatttatttagacagagtctcactcttgttgctcaggctggagtgcagtggtgcgatcttggctcactgtaacctctgcctcccgggttcaagcgattctcctgcctcagcctcccttgtagctgggactacaggcacccaccaccaggcccagctaattttgtatttttagtagagacggggtttcaccacgttagtcaggctggtctcgaacttctgaccttaggtgatccacctgcctcagcttcccaaagtgctagggttacaggtgtgagccaccaccccggccttacgccattccttgaaatttgcgtttatggcatctttgacttattcaataacacatcttgtaccatcgtgctagaaatgctaacttgtgttcagaatttctgcatccttcttaagtgaaactttgccaattaagtaaacctatgataatacggtaatgaaatcgtatcccagtatctcatttctagtgccataatagtgacaatttatcttgtcatcttcagaggggcttaacctcactgtttctgtcagtagtaatggatatatttaattaattcagcaggaagttctgtcttaaagctcattctctttcccctatgcggagagtgaggacaagcttctgcaaaagagccgattagcagaacttttgatattctgaagacagttactgtccctctcttgctctttctcttgttctgtgtgtgtatgtgtgacacacacacacatttaatatgtttatataaatattaacatatatatttaatattttccagtccttatctcaatgctcttgattgataatgaggggcagtgaaagtcattacagagatatacaaagtttacattaactgtatctagatgtagagtttttaaaatcatttgaactctgagtttcaatatttttttaaagcaataaatgaaagccttcagagtgcaaaaaattttaatatgatattaatttgaaaacctcaaagtctctgcagtgattttaaatatgatgcaaccttctactctaaaaataggaaatctagattattaaagtattactagaatatggctttagttgttaatttaaaaatctaaataaaatacaacagttttatgacagttctgaggggaaaaaaacactgtggattgtgtaggagttaaaggctgaatctttatttcctgctctctgaaactgtaccagtgattgacaaccacaaaatagagaaagattaatgcagaatatgtcagtgtagtagataaattccacacttcataaaacattttttcacagagattaaaaaaatagaacattatcaagagaacacaacccctgggtaataaatgttaatatttacatcaataatatactataaatattaatatttaaatgacactggagataacctaaggaaaaactatcagtttgactgggccacagggtggctcagatatttggtcaaacattattctgtgtgtctgtgagggtgttttctgaatgagattaacatttgaatctctagctgagtgaagcccactgcactccccagtatggatggacctcatcctcttggtgggaggcctgaatagaacgaaacagctgaccctcccatgagtactggggagctccttttgcctgactgtgtgaactgggacattggtcttttcctaccttcttaaatgaatgaaaacattggctcttcttgagcctcaaggctgcaagcttttggactataccttacctctgctgggtctccaacttgctgacttcaaatttccatactaatcagcttctgtcattacttgagccaattcacaattctttagacagtccccaacttacaatggttcaaaacgatttttcagctaatgatggtgtgggctgttttgtttttatttaataaattgacaattactttagctaaaataataaagattgcattttgttttttactttcaacatagtatttaataagttacattaaatattcaacacttcattataaaataggctttgtgttagatgatttggcccaaccgtaggctaaatgtatgctaatgtaagtgttctgagcacatttaaggtaggctaagctaagctatgaggtccagtaggttaggtgtattaaatgcattttcaacttgtcagagacaagtgaaccagagcaactccatcttaaataggagctgggtaaaatgaggctgaaatctcctgggctgcattcccagatggttaaggcattctaagtcatagaatgagataggaggtcagcacaaaatacagatcataaagaccttgctgataaaacaggttgcagtaaagcaaccagccaaaacccacccaaaccaaaatggtgatgagagtgactctggttgtcctcactgctactctcccaccagcaccatgacagtttacagatgccatggcaatgtcagaaagttgccctatatggtctaaaaggggagggatgaataatccaccccttgtttggcaaatctcaagaaataaccataaaaatgggcaaccggccgggtgtggtggctcacgcctgtaatcccagcactttcggaggccgaggcgggtggatcacaaggtcgggagtttgagaccagcctgaccaatatggtgaaaccctgtctctactaaaaatacaaaaattagccaggcctggtggtgcacgcctgtaatcccagctgctcaggaggctgaggcaggagaatcacttgagccctggaaggggaggttgcagtgagcctagatagtgccactgcacttcaggctgggcaacagagcaagactccatctcaaaaaaaaaaaaaaaaaagaaaaaggcgcaatcagcagcccttggggctgctctttctatggagtaaccattcttttattcctttactttcttaataaacttactttcactttgcactgtgaactcgccctgaattctttcttgcacaagatccaagaaccctctcttggggtctggatctggacctctttcctgtaacaaacttatgatgggtttattgtgacataaccccattgtaagttgaggaacatctgtgtgtgtgtgtgtgtgtgtgtgtgtgtctatgtgtagacagagatagaaagagagatagagagagacagtactctagagaaaccttactaataatatatgtagaacaaacaaacaaaacaaaaccatttctatattatgtcacacctaacttgttgctttccactctggtattattgttgaataaatgaacaaatgccacacagttacaaaatgatactttttccatttttatagccaattcaaacagaaaagcaatcttatggatactatggtccacatcataaaagcatattttatttttttactttatagagtagatactgtcaataaacattaatctaaaaattaatttttagattaatggcggccatactagttatagtttatgaatcatgtttggtcaactaatagcaggatataatttctacttggccaagcccagtggctcacagctgtaatccttgcacatcgggagctcaaggggagaggatcacttgagcccaggagttcaaaaccaacctggacaacatttctacaaaaaaatgtaaaaatttgccaggcacagtggcacgcctgtggtcccaattactagggtggctgaggtgggaggatcatctgaacctgggaggtgtaggccgcagtgaggtctgatcacaccactacactccagccttggcaacaaagtgagacctcacctctcaaaaaacaaatcatgtatatggacttagttcctttaacgtgaaataatgccccatatgtgtacactccattgatttgtaggaaaaaattgatgcaaggatgagggatgcataaaggaagaatttctccagtatctctcaatctttttttctttttctttttctttttttttttttttgagactgagtctcgctctgttgcccagtctggggtgcagtggcacgatccgggttcactgcaacttccacctccggggctcaagcaattcttcctgcttcagcctctagagtagctgggattacaggagcctgccaccacacccagctaaatttgtttgtattttctagtagagactgggtttcaccatgttggccaggcgtggtcttgaattcctgacctcaggtgatccgcctgcctaggcctcccaaagtgctgggattacaggtgtgagacactgtgcccggtccagtatctctcaatcttgatttaggggttagagacttcttggccccgactttgtgaccactttcactagttatctccatgcccgctctggagaagtgaagctagggaggccttcagctgctggctcactaggaagcactcacagcgggagggagccgactctgccctccaggtggttttaggtccacatctgtggagggccaggagctggtaactattctgtgatgcacgttgaattttctccactgtaactcattccttggacatcttgtcagttcactcacaaatgatatgttgacagtatttgtgttagaacagcgtgtcctaaagtggcattttacatgtagctgctttgtgcatttatcttttataatacaaaactattatccttaaaaaaaagtcatttaagtacaagcttaaaaaagactttcggaagtagttaccaatttagggatacacctgggatacgacattattctttttaatcaaaacttcagccccatggaaaatgtagcagtagacactttagatgacagtgacacaaatcatatccttttatgtttgggtaggctttaacttctaaaatcatctcttacctcattctcctacttttaaggaaaaaagtttcattttaccttggcatgtcatgactgctgacatgatttccaacatgccattaaatagaatcatcttgaagaaggaaggaggggaaggaagtggaggaagaaaacccagattatcagaggctctggtaaacatttgataggaatcactatctcccttggtcctcaaaaaactccacaaaccagatattgtgcatctggcaaaagcagaaacacaaagcagaaaggtcaagcaacttgcctctgatttcactattaaggagagcagagcacagcctcaggttcaggccctggttctagagcccctgttctaaccactgcttgcggctgcccaccctgcagaacatgctggcatactatgcagaggcaaaggcaatattttactgaaatgtcagaggtttatgttattggcatactacagatgaccttctttgtggccccaattttgcttcaaataatagaaaatgcacagtaggctggggatggtggctcacacctgtagtaccaacactttgagaggctgaggtgggaggatcacttgaggccaggaatttgagactagcctgggcaacacagagagactgtctctaccaaacaaagaaagtgcacaatagttccacatacacattttacatctgacagaaactaagaaacaaaaatctggaatacctccacctaagactgtacagcccctggttacacagatgtgactgaatatttctgtgggactctcaggttgctggttctcatttccattctgatttctgcatctttccactttcatgaattgtattttacactatgtaagttgcaaccatttggaaaaacaaacaaaaataagtatttttgcagctaattaatttataaagtttttatttttaattcacctcatttcaatggggaaataagtataagatacaaaatagagtcatgaataaaataaaataaaacgtgtataattggtatttctacatgaacataaatgcatgaatatgttgttcaattgcttggtccgagtaatacttttatttctgagagtacttgctgtcaaagaaaggttgaaacatgatcaattacaagacactcaaggttaataatagaatttagaaaaagcaatggacagggatgctgcacggtaaagttgtagagatcagatatcagccccaattttcttttttttatacagtggtgatgatgatgttgatgttaataatcatcttaacatttactgagtattaatattatgtctgcactattgtagcactttgcatgtattaactcatcgcctcttcacagaagccctaggaggcaatatatcagtaatatttgcattttacagaggcaggaagacagaactgccaaagtcacaaggtatattagtttgctagagacatcataacaaagagccacacactgggtgacttaaacaatgggcattttttgtctgatagttctggaggatagaagtctaacactaaggtgccagcagggttggctccttctgaaggctatgaacgaagcatctattccaggcctctttcctggttttgtagacacctgtcttcttctttgatctcttcacatcatcttccctctacgtgtgtctgtctccaaatttccctttttacaaggatattagtcaaattggattagggtcccttcgcaacaacctcattttaactcccatgtaaagaccctaaatccaaataattcctgggttctgcagtactcagtgtttaaaaattcaacatatgggctgggcatggtggctcacacctgtaatcctagcactttgggaggctgaggcaggcggatcacctgaggtcaggagtttgagacaagcctgacaaacatggcaaaaacccatctctactaaaggtacaaaaattagctgggcatggtgtcaggcgcctgtaatcccagctactcaggaggctgaggcaggagaatcacttcaacccagcagttggaagttgcagtgagctgagatagggccactgcactccagtctgggtgacagagtgagactctgtctcaaaaaaactaaataaataaaaataaaataaaaattcaacatttgaattctgagagatgcatggttcaacctctaacacacggccaggagatctgcacacaggcagcctggccctgcacccagcctcagggctacgcagagtgtggtctgtgacccgcaacctcaagtgccaccctgggtttcccttagttccttgaacacctttttttcagtaagtctttaggaaggtaacataatgtaggtaattcattcaaagtaagaatgtagctccattaatgacatgagtgcattctgtcctggctttgttggattattttattcttcccctttatttgtcctccctggatgttaagtcagccctgttgggtgatgtaaaaagggcgagtgtgatctcagggctcttagggagagagtcaacaccgtgacagcatcagtcaggcagtttctcacaggagccatcggcttcctgcggcttcctccggagccttccttcctgctgctccacaggggctgctgcatgggagatgctgccctgctgagctgtcatttaaacttattctgaagattaacaagacccatcacttgcagatactaagcccctatcatgaacacagtaaaatatttacttgaacaaattaaaatattctattcaatgatgattcagaataaattaaaatactgtagaagtgtgttttatgtaaatattttctcctttgttctggattttaattatcttgaatttttatttgcagaacatttaaggaagtttctgttttaaaccagccttggagggttttcatgacaaggaattgcacattggatgatcatttctaccttttgcaataactacttcttatttgcaagttgtgtttaagtgaacaaagacagtaagtattaaataattgaaaactattttttagcagatttgttggataacaactatttaaggaggttaaacaaatgcccttcagattttcagtcaatattggctattactaagctgacttgcttctttaatcacagggcttcatttgaagtccagtaactatgactttgagaagatccttggtttccacagcatgtatgattcatacccacaggtttccctgtgaaaccttttccaatcttttacactatgcttcagaatcctgtacctcctacttaaaataaagaacacttaactagtaaaaatatgatactgcaagatgagtgtcactagatgatagcatcatgcttccactgtaaccctgtcttcatatttaaacgcggatacactctttacttcttcataacataaagagataccaaatacttattcaatacctaacaatatgcagcatttatatgaactttgactaggtaatcttcctcaagtgggtcctagaacatacatacacacacacacacacacacacacacacacactgaaagtatcgatataaaatatagatacaaaaatgtttcagcagagattacagaagaatgttgaaactgcatagggcatgttcagaaatttcagagccagtggagcagcaaaaaacacagaaatcctgtcaggagatactatttccaaaatcctcagaacaaaacagtcaaactacagtgagaaaccctagagtgtgttcttgggcaaaatctaagaatttagccaagttcaaaacccgaagcgtcagagttcaccagttctgtcataataatttttccaggactcattttcctcatctgtatgatgagggggttagcctggataaaatacagggcctaaccaatgccctgtctctgtaagggcagcaatattgtggaagaatttctgcactttaaatatccgtcttggcagcaaatcctcagagtcatgaagtagcacgtcgtttatcctcgtgtatctgggcacagatgttagtgttacatccatccctcactactcatcaacatgagtccaagacatggatcagttctttatttagagataaaatgacaggatagatcctctctgtgtgtttatttcacaattccttcatgacttgcattcccctttctcatcagaatcagtgccctccatttcttcttaaaggatggtattttgacataaatggaaatgatttttgccttctgtgagacagggggttttttctccactttcttataggtcaatttccaaatcatgaatgatggactcactaattatagtactgtcaatgttttcttgacagggtctttatttttttcctccaggagacgtgggaatgagtacattcctatctaatgtgaaaatccaagtttattttccttttacataagatcactttttcccttagaaatcacatagatggattatagaagacattttataggaaattataaaatctaggaaaaagttgcaatattgcaaaattgctgtaatatggcaaatgaactgaaacatggggtttcatatgacatctagtaaattttattatttatactgtgaaatcccattaaataatgaaattaaaatagtttaacctgctaaattgtgtgttcttttgaccgctcttgacagggtggacaaagggtcaattaagaatcaccctttttgatgccagacaagctccagtgagtcagagcaaacacgttctgaagtgtcttactcaaccacatcacagaaactgtctcaacattttgccattcttaaaattagtctcccaagtctattcatgattcaaaggtggtgaacatcagctatatacttttctgttttgcaggttacttataattccttaggctgtttcttccccccatctctaacattctttcattctttgaagataagctatggacaattagggaaacataacataattgtctgtgcccttgcttgggtgtttcaaatattagtattgtaaaaatctgtgacttagagggattattctcacacacacacacacacacacacctattatccacagattaacttattctactcttaagaaaacattttatagatgtattctcaatacttccctttacggaggatgttttttctattattaaattttaaccatacataactggaaatcaattatactgaccacctgcccatatgagctattcaggcatcattttttttcccaacacgctatgagctgtgatgagaatgagaaaaatagcacttgataagtcaactccacaacccaactcagtattctacaaggttctctttatatttgattcatttgagagaaaaaaccctgagggtgaatatagagtaggtaatgttcaaggaaaaaaaaagcctattttagatattttccgtgtaaatctcagaatatgattaaaggaaagatcttttgaattcagatttccatggaaacactcacagcatttttcaatggcgagtaagtgagctacatgatctaacaaaccattttcttactgaatttaaaattgtgttagttagacactatcagtttccctccctgttcaccatgagcctgagttgtttccctaggcttggtaacatcctctcccctttccttgtccctgggttgttgttgtaaagtatgccatccctgtggttgttaattctaatgcaaatttattagtcaggccattctcagctccctatgatgggagtagaaatggggaaggtacccttggtaggtaacttatctcgttttgatttctaaatgatgtaaatgtaatagcttaaaaaaaaatctccatataactgttctctgcaccctctgattgggtaaatactcatgcaaattgaccatcttatcaaatatatttttatgaaagttaaagaacctgcaccacatacgtagcaagacaacttccagtcacttcttaccctctgagccttgggcttctctgcagctgggcaatgctgtacaaacagcataaatgctccagttgggcatttggtcttagaggggtaaaagatctaagaatgcttttgcctgttacacgattgggcaggttgtatttcatttttaaatacaaaagaagtaaataaacgatgtgccagaaatatatttgaatttttgtcagttgacatttcagtagccattatggacccaaagtcattttgtttgaggagctgatactggataatatatttttatttaacaaaagttatgataacatgtagtccacatgatctgaacatgcgtgtcctaaaaatatatttgaaaatgagagaaatgcatatagagatgaggaaaaccctagctgaaaagataaatatatagacgataattttttttaatttggggagaagatgatgaacatgaaaagaattatgagtttgaaaatctgtctacagaaacatcaggtaattccttatctgtgcacttacaacacatttcctcatatgcatgcctgacagctgccacagcaaagctgccattcgagaatttcttttaaaagttaatgtacacaaatgtccacgagagacttagtatttccagaagctttcgattggggtagagttgaaagggagggtaatattttgcagtgctgtggaataaagcagcatctgtctcaattacatccagctcttatatgcagaagatttcccaaagatggcagttttgataaatattgacctccaaagctctatcattttgtcgacctaaaaggaagaggctgagacacaaactctgtaatttaaagagtttactgagccaaagtgaagacagctgtcaggactcggacccgtgtaaccttggatatgagtttggcctttgttacaaacagatttttaaaggcaaaaaagggggagaaggcatggctgatacaaagttgtttgtcaggcattcttattgatttatagaaataacattgattagtgattggctatacattgttaagctacagggtgtgggttatagcgtttgctctggcattattaggttaatttatagctacttgtggcaataagcagtttcaggagatgaatacctagctcaaagcggggagtaggacttgactgctgcctcattttaatgtctctctgggcctcattatttaaaaggactcacattcctcagataaaagttcttttctcgccttttttttttttttgagtaatacagaatcaatcaagcaatattgtctccattgcacgaagtaatgtgttatttacaccatggatattctaaaatgaaacgatgaatgtgagttgttaaaaaagcaagtacaataaaaaatgcatgtccaaaaatggatactcccaagctgaggagctgagctgtcagcaacgggaatgatgactcttggcctgcgaaagtcactgaaaattgaatttgagggcacagaggaggatgggagtcagtggctaaaattgttgagaaggtcatttatatttttcttatttattatttctattcttcagagtctaatattttcactaattttaaaaaaactttttcttggccgggcgcggtagctcacgccttaatcccagcactttgggaggccgaggcgggcggatcacgaggtcaggaaatcgagaccgtcctggctaacacagtgaaaccccgtctctactgaaaatacaaaaaaattagctgtgcgtggtggcgggcgcctgtagtcccagctactccggaggctgaggcaggagaatggcgtgaacccgggaggcggagcttgcagtgcgcagagatcgcgccactgcactccagcctcggtgacagagcaagactccatctcatttaaaaaaaaaaaaacaaactttttcttatagtcccctaaatgtttaacaatatttaaactatcttcaatggttctaaacacatttggtacctttaaaattttatttcctattttataagacagatgagagatttggatgtaaacacacagttttgcatttaggtgtaatgatgtcttggctcttcaatctgaagagaaaatataatgactagtaattaagttggaagtggtatttgaaaaccatctattaattgttttacgtactttctactacctagttttaagtttcaacataatttttaaaaaaatgtttaatactggccgggcgcgatggctcacacctgtaacctcagtactttgggaggccaagatgagtggatcacttgaggtcaggagttgtattcaccaacatggtgaaaccccatctcttctaaaaaaaaaaaaaaaaaaaaaattagccaggcatggtggcacacgcctgtaatcccagctacttcggaggctgaggcaggagaatcgcttgaacccgggaggcagaggttgcagtgagcggagatcgtaccattgcactccagcctgggcaacaagagcaaaactcagtctcaaacaaaacaaaacagaaagtttaatactgatgccttcttgcatatctcactattcctagaattgcattttatttgttgttgttgttttcctttccctgctgggctggggtgggtggtgatatatgcagtgatgtttacaagcagagaggctgttgcagcagaggtctcatctaacagggagccttaatgagcagtggcgcttataaattagggagatactgaagcacgctccagattcagtcaggacctcaggatgagagcttggggttggggaagaaaacataaaagtggctgagtatttttgaggggttgatgagtctaagcccacttcttaagctttgctctttgatttcctgtgtactaggtaggtatttaccttctcctcctcctttttaagctggggtgcctgcgagcctccatgcagcattcgctggacagtgctgaggagtcagttatcagtgccgctggtggacgtgaacgttgctctgagaagctgtgtggccaagggtgacatttcctccaggcaggaaagtccatgagtgttgtttctttgtctttgaatgaacagtcaagccatgcctccagacatctttgacataagcacaggcctccacaagacttttaaaatactctaggggagaaaagtcctatcttttcttcacccgccacaaggtttacagcccaaaacccccataacaaaagacaggttaacaagagaaaagcataacaaaggtatttaatcaaagttttgcttgacacaggaggcttcagaaatgaagacccaaacacccagggggaaactgtatttttatgttaaatctgatgaaagaagtgaatagttgtggagcaacgtaactggacaaaagggatatgatctaatggtaataaactgagcagagcccagcaaggcctgtttgttctgattcttcttggtctctctgtgtgtaaccgcccaatgggttcatctagccccctgcctagacagagctgatttatcaagacaggggaattgcaacagagaaagtgtaatacacacagaaccagctgtgtgggagactgaagttttattactgttcaaattagtctcctggagcatttggggatcagagtttttaaggataatttgtgaactggtggggggcagtgagttgggtgtgctgattggtcaggtcatagggagtcaaagctgtcctcttgtgctgagtcagttcctgagtggggccacaatatcagatgagccagtttatcgatcggggtgatggctgctgatccatcaagtgcagcgtctgcaaaatatctcaagagctggtcttaggctttacagtagtgatgttatcccctggagcaatctggaaagaacctcgtagcctccagctgcatgactcctaaaccataatttctaatcttgtgactagtttgttagtcctacaaaggcagtctagtccctaagcaagaaagggatttgttttgggaaagagctgtcattatgttcattttaatctataaattataaactaagttccttccaaagttagttcagcctacgccaaggaatgacgaaggacagcttggaagttagaagcaagatggagttggttaggtcagatctctttcactgcctcagttataattttgcaatgacggtttcatgtgtagcattcctttctccaggtaaggggcaggactcctctggaatgagggtcttatgagctctcaggggaggtaggtaaaagataagctttctagattttatggcttgtttcaggagacagaaggatgggagaaggccaaagagaactacttgcttctaaaaccctcctgtctcctttagtgcaacaatccacacatgccaaggcaccatactttggggtactgtgctctgagctccgataatacaaagaagtagaaccatgtcacgctaaatgtttaatatgcagctgggggttttatctaataaatgcaataacaaatcatatctcctcatgacattagggttttagataggcactccattgtctcaaacagattttagcttcaatctctacatagctgctacttatttttatgaaaacaatctttgaaaattgttttcaagaaattacagggcagggcgtgatggcttatgcctgtaatcccagcattttgggaggccaaggcaggaggatcaccagaggttaggagttcaagatcagcctggccaacatggtgacatcccgtctctactaaaaacacaaaattagccaggtggggtggaatgcacctgtagtactagctacttgggagagtgagacaggagaatcgcttgaattcaggtggcagaggctgcagcgagccaagatcaggccaccgcactccagcctgggtgacaaagcaagactctgtgtaaaaaaaaagaaagaaagaaagagaaaacaaaaacaaaagaaattatgtaactggtctgctcaagataattaattttgtgtaattactgaacatattaaaggctctttattttattttatctttttttgagacagagtctcgctctgtcccccaggctggagtgcagtggcgccatctcggttcactgtaagctccgcctcctgagttcacaccattctcctgcctcagcctcccgtgaactgggactacatgagcccacgaccatgcccggctaatttttttgtattttcagcagagacagggtttcaccgtgttggccaggatggtcttgatctcctgacctcgtgatccgcccgcctcagcctcccaaagtgctgggattacaggcatgagccaccgcgcccagccgtaaatatttttttaattaaaaaaaaaaaaaagctggttagtattcttaaagaaatgttctgttgcagggtttggattgttattttcttaaagctgtttctttcggctgggtgcagtggctcacacctgtaatcccagcactttgggaggccgaggcgggcagatcacaaggtcaggagatcgagaccatcctggcgaacacggtgaaaccccgtctctactaaaaatacaaaaagctagccgggcgtggtggcgggtgcctgtagtcccagctactcgggaggctgaggcaggagaatggcgtgaacccaggaggcggagcttgcagtgagccgagatcacgccactgcactccagcctgggcaacagagcaagactctgccaccacccccccaaaaaaaaaaaacccacacacaccaaaaaactgtttttacgtcattatctgagcggaagcggaaccgcattagagggtgagtagttgggctaaataggactcgcctttctcatattcttttttcagatgataccctgttgagctggtaggtaggaagaaccagcgaagcgcacagttaccggagaggttatttgcccaatgttgagaaacatatgtgtgtattagaaaaaatcacatcgactcccaggaatcctgcaacatactgcaactgtgatgctgaccagaatgagtggagatttcctcatgatttctctgtgtgagatgcaggttaaaaaaaagttattacttaatatatgaataggcagatattgaataagctattgcaatgaaaaaaataaaagtatgccctagtgagtaaaaaatgtaagctgatgaaatataatacaattaatatgaaaactaaatatcaagatggaaggtttgctagttcactgtggataatagatcatgtacatttttctagtaaatagaaatacttggcttccattcactagaagtccaacatcatctctttaaatttaagttcgattaagcaatctattactaccaatatttaaagtagtaattcacaaagtgtatctgcttataaaagtcccatgattatctacatttaagagttaatgctgcatatcacaccccttggggacaccatacattaacatatttagttctgataggaatgtttacttgactcaatcctgattttccaaagtcatttaatcacaaaattatgtaggcaatgtcatatgatcaggaaaaaaagtgttccgtgaaccacaccctgcaaagggtgatctaaaaaatgtcagagattcgaaaatgtttcaactgtctttagaacaaagcaataatctcctgtggattgcaatacttcctttactgagaatttggaaagttttttgtagatttttaggttatagttggaaagtatgctgattttttttaacatggaaagtaaaagtggttttttaatctctggattaatttattaacatgtatcactaactcaaaaaaaaaaccttttttttttttttgaggtggagtatcactctgttgcccaggctgcagtgcagtggcacaatctcagctgactgcagtctccacttcccgtgttcaagtgattctcatacctcagcctcccaaatagctgggatgacagttgtgcaccaccatgcctggctaattttgtatttttagtaaagatgttttgccacgttggccaagctagtctcgaacttctcacctcaagtggtctgcccgcttgggcctcccaaactgctgggattataggcttgagccaccgcaccggccctcaaaaaaggtttcataaagccctagtgcttcatctactagcctatgtatctccaaatccatttgaccatgcagcgtacatttatttttaaactcttaaaggtcaatctgggtgtatatatcattgatttggctacagaatgtcagttatattttatgtctttggttaaaaaatgaggatacaaaattttattctcaaaacacgtttatgtaatgttgattaataaaaataattcacctactcatgtttgataattaaataattagttttatctttcccatcacagtaggtgacacatagaatatttaggttttgattttgtcaagatgaaaatgaatagcaaacctgtttggaattctgaattcaatctcaataaggaatagaaaaaaaaaaagcagacttcattttaatttggtttgtattattcccacaggaatatacctggggcagataaatcttatagaaaatcagatgtcctttcatatgagaatagagttcaatgatatacttttcatcatacacatcacaggacaatgtcatctttaaatatagtaaagggggctaggtgaggtggctcatgtctgtaatcccagcactttgggaggccgaagcaggtggatcacctgaggtcaagagtttgataccagcctggccaacatgacaaaaccccatctctactaaaaatacaaaattagttggcatggttgcatgtgcctgtaatctcagctacttggaggctgaggcaggagaattgcttgaacctgggaggtggagtttgcagtgagccgagatcacaccactgcactctagcctgggtgaccgagcaagattcattttcaaaataaataaataaataaataagaaaaaaatatatatatagtaaagggaacaattacattctacaatattgtagcagaagtaaatatggtttaattcaatggaaacagctctgctctatagaaaattcacaaatattaaaaataaacacactctacattaaacctctgagcactggaagctcacctacttattcataggctcacatactgtaagggggtaaatcccaaaacccagataagtcaaatgaaaacttcactgtgccctccctttatctattatattatgtgcagttttgtgagttttcaacataaatgattagcttctgaggagttttaaaagcatttgccatagatcaacgatagtatgatctaaaaatgagtcatcagttaaagctacagtaacatgaatatatattaatagttacagtcaatgaaaaaatgatgactttatttttgtctttaagggtataaaaagcgtattcaaagttactgagggtactcagagttaatttttcacatcaaagggaaagggctaaggaaggaattgtttcagcctttcattcaacattgtaactgcaaacaaaaaattactttgaaataaacatacagctgtaccccttgctaattaagaaagaacttcttggtcataattatataatggccaatttttacttctaattccggcttggatttccctagtttatttattagccattgagttattatgatcatcgttgttagcctttagacataatatttgtattagctgttgattaattttttttccaaaatttacataactctggctgtcctatcaatttcccatagagttatcattccacttgaatctgtgaaaagtgtctgattaaaaatcatatggataattaccatcaacactcaattctcagcagctgttgaggaggagcttcagttagatacacatcatcccaaagagaactcatcgtgatggaagggacattagaaataagaggagagtggttaaatcagtaaaggattgactccattacactgccatctgttcatccacgaccttgcttccattattctgtgcccatttattgatttaatgacattaatattgtttgacaactgcccagtgtctgcaataaatgttattttttttgctcaacggttgttgcattgaccatgaaaatgtatttgagcatcaatcattttcactgtacatctggttagaaaatattggacactatacgaaggcctttataaggcaaatacagataacttgtatttttagtaaattctaccaatgaagctgtgccgatgacatacttcccatgacatgtctgagaacacagttcccgtaggagaggtgagctaccaaagtgtaagcatcagtaagaacagcactccaagttatcgcaagcacctattttttttttttgagtcagagtctcgctctgtcccccaggctggagtgcagtggcgcaatctcggttcactgcaagctccgcctcctgggttcacgccattctcctgcctcagcctcccgagtagctgggattacaggcgcccgacaccccgcccggcaaattttttgtatttttagtagagacggggtttcaccgtgttagccaggatggtctccatctcctgaccttgtgaaccgccggcctcggcctcccaaagtgctgggattacaggcgtcagccactgcgcccggccacaagtaagggttttaaaggcaggggtaaatttcaggaaaacagaagttacaacattgtgaactgatacattggtttggcctaaaaaggtgggatagtttgaggtaggagattaccggtcataggtatattcaaagactgttttgcaattgatgaaaaaagagtttgtttaaacatttggggtcagcagaaaagattattagctctggcacgtgggcacggcttcctccaggtccctcaagaataaatttagagccaaggacaaacggagttcggggttcagtcctcagctcccccttatctgtgttctactcgccagcggatctgctcggtagggagtctgggtttctgaaaaacaactcagggacatatgttaaaatgttgcctttagtttcaaatatcttatggctagaacttccttggctgttgttttaagctgtgattactttcttgcttatcaagttgcttgcttctcagggctagctaggtgcctggaatttcccttgaaggaactcaatattttcctttatttccatgcatgggggtgcagggtggtggatggagggggtgcaggccccaagagggttccctgctccattttagggaccgcacttgtgaaacaatatcctctgagtaggagattcaattttttcccgtgacaatcttaaggtctatttcaacaaagggccagatagtaaatttacttttgttctagaggctgtaatgtctctgtacagctgtgcaactcaatcacaggaaagcaatcatagataaaatgtaaaaaaatgggtatggccaagggccgggagcagtggctcacgcctgtaatcccagcactttgggaggccgaggtgggtggatcatgaggtcaggagatcgagaccatcctggctaacaccgtgaaacactgtctctgctaaaaatacaaaagaatttgccaggcgtggtggcgggcgcctgtagtcccagctactctggaggctgaggcaggagaatggtgtgaacctgggaggcggagcttgcagtgagcccagatagcaccactgcactccagcctgggcaacagagcaagactccatctcaaaaaaaaaaaaaaaaaagaatgaaaaaaaaatggttatggccaagtttaattctttgggccatagtttaccaaactcctgatttagatgattagcaatagtcctacaaactctgaactctgtatatcaaggcagtatataattaaataactgattttaattactataggacttcaatgaaaggagagaatgctatcagttgaaatagttttctgaagataaaatggggccagagacttcaggaatcagcaatatatttactgtctgttaaactaatcgccttttattacgtgctaatcaagttctgctttatttcatatgacaagagtggttttgaattaagtaactctcagacaattgtttcagcaaatgatttagttctcatttccatgcttacgtataagttctttcactcaaaaaaaagaggaaatctttaatttaggaataaaatacagaggattgcttcaagtttgatttgttttcaaagcctaaatttataacttttatgttgcccttgccaatgattatttgcagttacagtctgtagtttcacatcattaataactagaaagaaaaatgggctttttatttggcttcaaagtgggtgacgagttttggagcttcatctgcttgccgtgttgctattgatgccaatatatttgcgacttcccacttgcaatatcattatcaacaggtagagaaagacataatggtttcaatctccttgctgacaaacacttctctacacttgttaaatcacagatttagctaaaaaaaaatgaaaggaatattccccgttggctgtgaatttataaaaattgctttctttggcagacagtcctgtttcctgtctcagggaaaatacacaaagtataatgaacaccatggaggcatttcctaaacttacatctcattattcaatgcagggagcacagactctgaagagggaaaccacaggggaaattacacataccatttgtcaacttacattcctttaagcaaaatgcaccaaattaagaattcgggacgatagttttgcattgctgagtacatttgaaaatcatttgaggccgggtgcggtggctcacgcctgtaatcccagcactttgaaaggctgaggcgggtggataacctgaggtcaggagttcgagaccaggctggccaacatggagaagtgatggcgtggtggccaggcttggtggcaggcacctgtaatcccagctacttgggaggctgaggcaggagaatcgcttgaacccaggaggagggggttgcagtgagccaagatcgcgccattgcactccagcctgggagatggcccaagactgtgtctcaaaaaaaaaaaagaaaagaaaagaaaatcatctggatgctggtcaaagcttaaatgctaaaaagttctacctcatgagtttgttttgctggtatgtgtggaatccacctctatctttctcaggctctctctcttactctcttactccctccctgtttccttccttcctccctttcttccactttccctctgtctcttccaccctccctccctctcttcctccctctcttccttccttccttctttcctgtacattctcaccagctacaaactttggaccctcttgacaaacgtttttatgtcttccatgaggatgattactactagcttgttgctgatggtaagccacatttcctgtctccatattgaagaaatgaaatggcagcttgaaggcagcaggacagagattcgctgccaaacaaccaaatcagctgtaactgcctattggtatggaggacagaagggctccaggctgtaccatcattgagatgcaggaattcaagtgagtcctccgtattcgaactggcctggagttggtgcttgggagttgatggctacttctacatataactacacaaagaactggcttaatattaatgctcaagtaaacgagtcactaaacaaacaagaaaaacaagaccaaactatgaaatctgttgttaaaagtatattaaaattcagattgaaaatgattgaaatcaattattaaatatgtttcaaaaaaagaaagcatgctacatccatttggtttgttttcataggtaatatcaaactgctaaatatcaccttaattcagtcattgataaatgtgtgcaatgaggtgcagcccacaaagcctttaatcagtgtgaccattccaatatctcatggcctttaattttgcttctgttcggttatcaacattggatgttataacatcaggtggcatgatgtgtgacatttgtctgtcattcattcattccattatttattgaatgcctatcacagcacagaacttgacatgggagtgggagagtaatcgtgaacaatactagtaaaatgcctgctctcatgaggattatgttcctgttgtcatgaagttgtcatctacttctagatgataaacaagaaacaaataatcaaaatgcactcaaagaataataataagggcttgaggaagttaaagcactttaaggaagttaaaaaaaaaaaaactagtcatgggacagtggctaatttagtttgagtggtcagggaggcctcttcacagagttcacattttgctgaaaactaaagaagatccagccttgagaagatgtggaaaagggaacagcaaatgcaaaagcctgatagaggaagagctttggatggtgatatttcaacaagaacatcctcaaggctggagcagggtgaacaggagggaaaccagtagcatgtggaatgggatcaaatgagcgttcaactctatttttccagggattggggaatcagataaggccccccatgtatgctgtaaataaccaagactgaccttctacattaaaagagagagatgtgtctttccttttgaatgttaaaaacagtttaaaagtctttacaaaattaccaaagacaaataatatcacatatatcaaatttatccatttgattaataatttttaagattttgaagattaataattttttaaattatttttatttcatgattttgcataaaagttgtgagtgaaatagatactgtgattggagaaaagataaggagacaatgtatatgtgtctatttggcagggggtggggacacgtcataatatatatttggtacgcatcctatctagtttctaattaaaaccaaaattggctgggcgcggtggctcacacctgtaatcccagcactttgggaggccgaggcgggcagatcacgaggtcaggagttcaagaccagcctggccaatatggtgaaaccccgtctctaccaaaaatacaaaaattagccgggcgtggtggtgggcacctgtagtcccagctactcgggaggctgaggcaagagaatcacttgaaccaaggaggcggaggttgcagtgagccaaaatcacgccgctgcactttagcataggagacagagcaagactccgtctcaaaaaaaaacaccaaaattataatatgactcaccacagcaacccatttacatcttctgttacatggcaacaaggaactaaatattaatcataaacccccaaagacattaatcctaggatgtaaagtcactccctaaatcgctacgtctttaagtttcatggttccactccttgtctatgggtgatctctgttgtagaatttgtcccatcccacttccttgggctgcttccctcagtaaactcacacattcactctctccaataaaatcagaataatgatgaagtggtaccactttcttgcttcattggcaaataactatggaagctaagtgtcttgttaagaactatattagcagatcatagtgagccctagacttgctatctcttaaacattgatgaaagataagatgtaaaactagcagttgctgacttgcattaataaagtgttaagaagggcgagagccaaggattgccacagggaggaaattaagtaacccgcttactgcatttccttgggcaactgtagataaaatgtttggcttgggtaaagaactgttaaaaccttaaaataaaatttaatgaccccattttttaaaaacttaatttttaatcaggtttttaaacacagtataattccttcagtatggcagctgtgccatagagttcactctatgtaatgtttttgtatttaaaaaaatagtttgtactttaaaaaaatacatagctgtattgacatatagtttatacaatgtacattttatccatctaaaagtaaaattcagcctcccaagtacctgggattacaggcacctaccaccatgcctagctaatttttagctagctaattttttagctagctaatttttagctagtatttttagtagagacagggttttgccatgttggccagacttgtctcgaactcctgacctcaagtgatctgcccatctcagcctcccaaagtgctgggattacaggtgtgagccaccatgcccagccttttttgtggttttgatttatattgttctaatgacaaataatgttgatcatcttcctatgagcacataggccaatctttggaaaaatctttagtcacatttattgctcatttttaaactgggttatttgtctttttattattgagtggtaagtgttctttatacattctggatataatatcttatcagatatatgatttgcaaatattttctctcattctgtgtgtcgtcttttcagtttcttggtagcatctttggaactacaaaaattctggccaggcgcagtggctgaggcctgtaatcctagcatttagggaggccgaggcgggcagatcacctgatgtcaggggttcaagacaagcctggccaacatggcgaaaacccgtctctactaaaaatacaaaaattaacctgtggtggcgcatacctgtaatcccagctactggggaggctgaggcacgagaattgcttgaacccaggaggcagagattgcagagagccaagatcacaccactgcactctagcccgggtgacagagtaagactccacctcaaaaaaaatttttttttactttaaaaaaaaattcaattgacaaataatgactgtgtgtatttatgggatacaatgtgatatattcatatatgtataaattataggaagtccaacttatctattttcttcttttgttgcttgtgcttttggtgtcatatctaagaaagctaaagtcaagaagatttttttcccctatgctctcttctaagagttttataattttatctattaaattttagtatatatttttgaggtaactttttgtataaaatatgaagaaagggtccagtttcagtcgttagcatgtgacatccagttttcccaacaccatttgttgaaaagactattatttccattgaacagccttggcattctggttgaaaatcaactattaatgtaaacattgatttctagactcttagctgtatcccattggtctatatgtctatccttatgccagtacaagtctgtaattattactatagctttgtagtaaattttgaaatagagaagtgtgcatactccaaatttgctcttcacttttgagattactttgactatcaggagtcccttgcatttccacatgaatttttggatgggcttgtcaatttccacagaaaaggctgttgggatttctatagagacgtggtgactgtatatcaatttggaaagccatcttaataatgtctcccaatctctgaacattggtgtcttgtcatttatttactcctttttttttttttttaccttctttcaagtatgttttgtagttttagggtataacttttgctctttttgaataattaatttctaagcattttcttttttgatgcgattatcaatggaattgtcttaatttgaagtgttcattgctagagtagagaaatacaatttttttttttaaatttaaaggagtttaattgagcaacaaacagttcaagaatcgggcagccttcccaggcagagtaggctcggacactccagcacagtcacgcggtggaaggtttatggacagaaaatggaagtgaggtacagaaacagctgggtttggctgcagcttggcatttgccttatctgaacatggtttgaacagttggctacatttgattggccaaaactcagtgattggcacaagtgtagtctgtttacacctccacttgtcacaatatacagacaaacttttaggccaaacttaaatatataaggaggcagctttaggctaaacttgatttcaacacctgtattccaacactttgggaggccgaggcgggaggatcacttgagcctagaagttagaggtcagcccaagcaacatagtgagaccttgtctctgtgaaaataaattagccaggcatggtagcatgtacctgtagtcccagcttatcaggagactgaggccagaggatcatttgagcccaggagttcaaggttgtagtgagctacaagcgcgccactgcactcctgggcaacagagcaagaccctacctcaaaaagaaaaaaataatgacataagcaattatgtggaaataaggtcatacctgtcaaagtaatcagctgaaagcagttgcctctgaggtgcaggaaagggggaaagtggagataagggaactacttttctttaaaaaaaaaaaaagacaaaactaacacttcaagccaggcaaagtggctcacacctgtaatcccagcactttgggaggccaaagcgggtggatcacctgaggtcaggggttcaagaccagcctgactaacatggtgaaaccctgtctctactaaaaatacaaaaattagctgggcacgatggcgggcgcctgtaatcacagctactcgggttgctgaggcaggagaattgcttgaacctgggagacagaggatgcagtgagccgagattgcaccattgcattccagcctgggtgacagagcgagactctgtctcaaaaaaaaaaaaaaaaaaacaaacaaacaaaaaaaaaaactaacacttcattacctctgaatggacattaaaaaatattttaataaataaaaaaagatttaatacttcaaactatgggcacacaaaaccttgataaaaataaaaacaaatttagaaatctattattaataggacagcatgttgagagactttaaaggagttttttttaagtattttaaaaataatctcaaattcatagaagtcttggaattaaagtacaaagaacttttgttttgctaaatgacttgaaagttcctgacctgactccctataacccctacatactgtatgtcttctataaacaaggactgaatgcaataaaattgtaatatagctagcaaaatcaggaaatcaacattaatagatttctaccatccaaccaacagacctattcaagttttgccaagtcaggatccagttcagaatcaccactgcacttatttctcacgtctctttcatcttcagtctggaacagttcttcagtctttccttaactttcatgactttacacttctattacaggccaattattttgtagaattttccttaatttgaatttgttgctttaggattagattccagttatgtattattggcaggagcatcatagaagtgatgctgtgttcttcttgctagactatcaggaggcacacgattgcaatttgtcctattactgaggatgttcattttggttacttgattaaggtggcgcctgccagatttttccactgtgaagtgacttccttttgtaactaatgaataatttgtgaagagctgctttgaaatgacgtaaatatctgttgatttgaaaatacaacaaaattatactatgaatggaataatatatctaaattaatttgcattttatcaatgacaaccagatccacatacttttgtaaaacagttgctggtgtgtgtgcgcaacaggttgttgacttaggcaatgtgtggaatgttctggattcctagaccccgggcagtagctccaagacagttttgaactttcaagtaagacaaacttagttttgatttccagttgtacacttagaagctatggatggtagattctttgttggggaaaatggcagcaattctcactccctgtgtctacccctttggttgtccccttccataccggctggccatgcccttgtgacctgctttggccaatgggagaatagcaaatatgacataagtgagacatgggaagttcttgtgttgctgcccttatgctgcttttgaaactcaacccctatgttcaagctctcctggataatgagacttgtggtcgcattcccatcacccagctgacgatgagctcctcctgtccctaaaatatgaggtcccttagccatccagcccccatccagttattgagaaacaagtattacctgtttgaaatcataaacgggtggtttatgatgcagcaaaaactaacttacatacaacatgacctcatgtgggtttcttaatttctcacagtctcagctttctcatctataggatggagataaggcaatcaacctcgctatttagaggattaaatgagaaaatatatgcaaagtgcttggcatagcataaatactcaacacatatggtaattttttaaaaaccctctatattagtcccttttaattaaaattttaattaaaacaaaagaaaaacaaaacaaaacaaaaacctctgctgggtggatgaggggcagccctcaggctagatgcactgatttagtacttttaatagtggcaggagtcagacaagcccctaggcagatagtggcatgtccccaatgaaatccaactttcaaaccaaaggcagtttaaagcccaaaagctaagctacaagtcttggataaatccatggaccgagctgagaacatctcttcctgttggtgcactttcctctgactgatccccacacttcacttactttacatatatctacccttccctaagtggttttctacactgtcatgccacctttgaatggttcctttgttttagccttttttgtatactcgtaaaccaatcagcatgcagtccccacttctgagcccataaaagccccggacccagccacgctgggagagagaccacctgacttcaggtcagggaccaccctcgcatcccctctccgctgagagctgtttcattgcttcataaaactcttctccgcccttttcacctttccattgtcagcaaagggtacgaagaaggcagtaacaccatagccctccacccctcccccactatctgtgcccagtggcagccccttgccatgagaggcagtgcagggccaggccagccagggagcctctggcaggagcaggcaacaggactgacagagttgttaacacaccccccattcattgttaacatgcccgtttgtcaggctgctgacggtgggactaaaagagctgttagcatggctgtaacatcccctctggggcttcagagtcgagtgctttcctgtttgggcgccaccaatttcccttcatctgcatgccagagttcacccccggagtcacttccaacaggcctgatgaagctgcaggccccaaagggagcccgctcctgtgccagcacttggagttgctggcaagatgaggcactcacttgatcacacgccccctcctactggggctgagcatgcagtctcggtggctgcaggatccccaccagagtgcaagcccaagtgggcagggcacctcctgcctggggcagagctaggcatgggcaggggcatcgccagccagaagtctgcagttggaaaagtgtccgagaaaaatcctgcgtcactttggaagcagtcttcctatcctagaatgccagagggcaagcatctgaaagatctggaaggatgaggcagcaaaggccaagatgtgaatgtacactgcccctgtcagaggtgatcgaaccagagcgattccatcttgaataggggctgggtaaaataaggctgagacctgtgaggctgcattcccactagcttaggcattctaagtcaggatgagatagaaagtccgcacaagatacaggtcacaaagaccttgctgataaaacaggatgcagtaaaggagccagccaaaaccaagacggtgacgaaagtgacctctggtcatcctcactgctcattatatgctaattataatgcatttcgatgctaaatgacagtcctgccagtgccaggacagtctacaaatgccatggcaacatcaggaagttaccctatagggtctaaaaagggtaggaaccctcagttgcaggaattgcccacccctttcccggaaaactcatgaataatccaccctttgtttagcatatgatcaagaaataactgtaagtatagtcagtcgagcagctcatgccgctgctctgcctatggagtaaccattctttcattcctttattttcttaataagcttgctttcactttatggacttgccccaaattccttcttgcaggaggtccaagaaccctctcttggggtctggatagggacccttttccagtaacatccccatcacagccctaatcactaggggaccctctaggctcttcctgccctccccagactgtctcccttaaacatgctggatgcaggggtgcatcagtgactccgctggtgcctccaggaaaataaagtgtggacctctgtggacaagaaacaacccaaagtaaagacgactcctcacaggcaggatggatatccagttgtatgtatgtcggtgtgctggggccgggaggctcctaataacaatgttaccgctgcttcacgtggaagaaagctgaggctcagagagattaaggaacttgtccagggccataccggagtccaggcccgtgtgctgtcatggtctgaggtttgaactccaaccgtttaaggagctgggatagaactggggagggagtgtggtgggtgggaacagcgggcagatagatgctggctggtctccgaggggcctaggttctgccagagggacaacaggtgaggaaaacaggcctcggggtggatgagtgaatactcagaggatgggcgcagacccggagggccgtgaaaggtgacagggttattacagtcttggttgcataagggggtaactagcggtttcttggctgaaaaagaggaggggggctacagcttcccccctccaagggcggagcacgcagccgctcagcaggctgccacacagggtcccccacctccgcagctgggggacctgaactcgccaataggaggttcctcctgcacgcgcggcttcaccctccctccagggctcccgttgcatttcactccctgcctaaggtcgcccgccggtgagggcggaggaggaagaactgcagctcctgaggacagaatctgcttcaaggcaccctgaccggcgcccaaccccaccccggctgcggcccgccgccctgatccccatcgcgctgcacggtcttcccttccaacaccaagggcgctgcaaggacgccctgtccctgccactcattcatattaatgactcctcccaccatgctttcctcaggtgtgttccgaccgctctgcccgaaacattttcatcccacactcttacggccacctctccccaagttcccttccgtctgggcaaatcttgtcctttacccggcactggggtcgctccagagctttcaaaccagcttccccagggcgctgtgcagggccgggcccctacaatttttgtatattgatcttgtaccttgccgtcaagctgaacttgtttattagttccaataattttttttagtggcattgttggggttttctatataaaggtaatgtcatctgcaagtagagctaattttacctcttcctttccaatctgaatgcctttactttattcttcgtttaattatcttatcttggctagaacctccaatacaatggtaaataaaagaggtaaatgtgctgcagtgagtgcttcaagttttatgttgccttagcatccattttcaaatatgtgtttaactttctcaaaccagaagcagggttcagtcacccttgatgcagtttcctgtactataccccccaaatggctccaggtggtgaccagaaataaaaacttggaggcatctctgtctcgtagcaggctgggctcccagctttcctgctgcttcctctaaacagaccatttagacactttcagtcacaatgtgacttcctagtactagtgcctgcttgctttaagcccatcaatttaaagctccctgtttatataatgccctggacccaataaaggcattgacctccgtgtgtgtgtgtgtatgtgtgtgtgtgtgtgtgtgtgtgtgtgtgttttctaagcatgctgtgtgccccccagggaactttcacactgtggtcatgtcattgaagccacatctgcaatctgacccatgcaggtggatctcctgctgctgcgcttctgtctgggtctctggtggctgcagaaacaatggctacaagctgagcagataaagaaactcagagagttcattctaaacaagtgaacaacctcttcttcctgatttaaggcaaaaagcatttaacctttcatcatttatttctccacaagtgtggcatgtcatcattgccactcactgacccacacactcatggttcatagcctgagaaatagtttgcaaaggcatatttaccttcattgaaaccttagaaaacatttataaaggcagttcaaaaatcaaccttaaaatatgccataaaaagacagagagaggtaagaagatactcatgaaatcagtcattgtctcaaacaagaataattttagagaaagtggattgggtccttctttccctggttctcttgcttttttctattctcttctgcaagcaataatccttttgtctggcttcttcattatttcaaaggagaaagtacaatatcagcatgcactcacctatactgtcaattccagaaaaaaatagcagagttaaatataaatggaccttagtcatatttaaccattgctctccttgacaatccaaagcttaataaagtacatctctttgcatttagaaattcatatattcatactcatactgttaacctactaaaataaaaaagtagatggaaataatatacatggagctaaagtcaatattaaatagtcccagacatatggtttgtgactaattattaaacataatatatgaattcttccggtgggttatacaattttaattggttgattaaaggaccattctattcttcaaaggagataatcatgctaaattttaagaaaaattacagtggaggtattcatttatctatgtctttataaaaatgtaatataaaatgtttatgcaaaggaggcctgtgagagaggggagtgtaagggtttaataagatatttggagtagtttcatcccatgaccacacatgttctgctttaccatctgcaatctcattagctgtccatgaagatgctgtgctgaatgtagacctgaaatttagacataagcactcacatatatgaaatatacattgctagaggagcaaataaacaaagaagaaaaacattttttgatttgtggcttcacttttgaacaataaccaaaaatattctacatgctcaaaggaaaaaaaaaactcattttattcttatgagaccaaaggattttattcttacgagaccaaaggaattgacaacagaaggtgaaatacaatgcaaccagcctgggaaatctttctgcttggttcagctgggccatggacaatttcaaaacgaagcaatgtgaaaacagcacattaatgaatggatagataaagaaacatggagagaagatacattactttggctaccagaggtacaaatgcaaaaagattctccacttttgactagtagaactgatgatggatttaaaatcagctgcacattgagggatttttgttcaagtgtaacataaattatgttacaatatgaggataaaatatgttattttgggctatgttttagtgcataaacactaacaacattaatgaatgttataataatttacttgaaagatgtttaatctatttgtaaatagctctgtcacctgctgaatggctttcatatgtttcaagtaatatttaatttctaaagagtatcctagactttactctgaggatttattatattaactctctcaaagagcccttatattgtaaagagaatgttatctagaaaacaaacctcctgggtgtcacacgttgctagttatgatattgcttaaggtaaaatgggaaaattacagcccaaggctatttcccagttacctctgcttagggacaataactgaacggccccacagaaaacacgttagggtagaaagggcctgttttccaggaattcctgcttcttcatgttaagtaccctcccaaccaagtgaaagcaaagacttcttagtagaaaggcaaattcagcaaactactttccttttttatctgagataaaaattaagtgagtctttgtgtttttgtgtattgatgttctcaagttttgcccttgtttattttctgttctttattaatgaatcagtagttccattcttgagttgttttgaattatttcacctggaagaagacaaatttaagaagtcctagtaagtaagcatgaaaaggggtcttaaatgagtatcaggaatcaaatgcactgagtccccgggtgagtattcaacccctggggactgagaagtaatcctttccactgcctctattttatttctcttgaagaacataaaaatctaacaaaagtgcttagctatccaaaattatcaaatattgaaagaatgattttttttccacatcaaacaaaatttagttaaatggtagtttccacatagatataaaatgttgagcagcattagagattaaccctgtgaggtgggggagataaagaaaggtttagtggtggtacaattagctgaggagtcaagagaaatagaaaacaaaaaatcttctattttgtcttctttggatcatgaatccattgttatgttttatttttattaaacaattatttcccatgctggaagagtgaaagagttgagccatcctaaggaacttaaggtgtgacaatttacagagaagaatagttgtaacattgctcatttactctgagtataaacatgaaaaatagttttaaaaaatatggtgaaataatttattccacagagaagtcatggagctctcttacacatcatattgtatactaatagctttgggtgggtggtcttcaggtgatagcacagaaatggagtacgaatttgcagggaaatgatacaaattgaatcaggcttcagtttaccagctactgattgctattaacagggcattttgatgtgagtctccactaagcatgtgagttagaaaatagctctaaagaccatccttgatggatcattactttgagatgcaaaccccagattgcattattaaaacatcttggaatcaattctgtgcatttccaaataagctctggcatggatatgaccacatcattaatacagtttacttctctggatcctagactcttttctttttttttttttttttgagatggaatcttactctgtgcccaggctgaagtgcagtcggctcactgcaagctccgcctcctgggttcacgccattctcctgcctcagcctcctgagtaactgggactacaggcacctgccaccacgcctggctaatttttgtatttttagtagagacggggttttgccatgttggccaagctggtcttgaactcctgacctcaggtgatccacccacctcggctttgagaacaagaacaccatatctgctggtctcaaactcttcacctcaggtgatccacagtcctcagcctccccaaatcctaggattacaggcgtgagccactgcacccagccaaaaaaactgatgctattttctatacaccttgcaccttatggatgtgcctaccagagatctggattataatcctaccttgtcaccataaaaaattcattcctattggacactgacatgaaagccttatgttacgttttgtgattaagcagttttctcttacagcttatttacaagggaaagagaaaggaaacaagaaatagtttcaaaaaaacagcccaaatttcagtaatcattaaaatcaacacaattaaatactctttttttggaatgaaatttcgctcttgttgcccaggctggagcacaatggcacaatctcagctcactgcaacctgtgcctcccgggttcaagcaattctgcctcagcctcctgagtagctgggattgcaggcgcctgtcaccacgcctggctaatttttgtatatttagtagagacggggtttcaccatgttgaccaggctggtcttgaacttctgacctcaggtgatccacccgcctcggcctcccaaaatgctgggattacaggcgtcagctaccactaccagcaatgaaatactctttttaaaagccttgagggaaccttgtaaagatctcaaaactctaagatattttcacatcctgtccccacattccaaggttaggaagattgagaaggtattcatttactattagttatttattttattgttatttatattaaaaatctcaaggcaaaatattaggtgattatcccaaaagattacattaaagcgtattccataattaaatatacatttcaaatttagaagttagttttaaaagctcatcagttaaggtctggaacataaaaaacatttcataaaattaaggtttcggctgggggtggtggctcatgcctgtaatcccagcactttgggaggccgaggtgggtggatcacgaggtcaggagatcgagaccatcctggctaacacagtgaaaccccatctctactaaaaatacaaaaaattagctgggtgtggttgcgggcgcctgtagttccagctacttgggaggctgaggcaggagaatggcgtgaacccgggaggcggagcttgcagtgagccgagatcgcgccactgcactccagcctgggtgacagagactccatctcaaaaagaaaaaaaaaaaattaaggtttcactgatcctctgtcccagcagttctaatcccacgagaactaaaaaacataggttcacatgaaaacttatgatagttcaaggcatctttatttctaacatctaaacatcccagctgtccatcaataagaaaatgggctaacaaatggtatacaatggaacagtactcacaataaaaagaatcaactttttttttgttttttttttgaaggagtctcactctgttgcccaagctgaagtgcaagtggtgagatctcggctcactgcaagctccacctccgggttcaagcgattctcctgcctcagcctccggagtagctgggattacaggtgcccgccaccacacccggctaatttttgtatttttagtagagacagggtttcaccatgttggccaggatggtctcaaactgctgacctcaagtgatccacgtgcctgggcctcccaaagagctgggattacaggcgtgaagccactgtgcctggtcaagaatcaacttactgataaacacaacaagacagctgaatcgcaaataatagtatgctgagggaaagaagcttttaacaaatgcctacctgccagccctccttccttttcttcttttatgtttttaacctggcttaattttcttggcttcattattttaagcaatttttgcagtgttgaaaaatttgcaagtaagttttcagaaacagttaacttcaaaatcctacacatgctatacatgaagacagtaaaaacatggatggaaagaaagaatcagtttatttacattttctgtttatatgataagtagtaatttagctgaggttgacaattcatttaaatgagataaaagtcatttacattgtctctgtggctgttttcacgatacaaagggatgcaaaggtagggtgttactgagcaaacaatgggcttgctgcctaatgtacatggaggccaagaccatggcactggcttttgaggaaaaaaaagcttcattgcaagtggactggcaaggagacaggaggaagtgctccaatatatcacccccagctgacgtttgggtcgggttttataagcataggctaatgaggtgtgatctgattgaattctgcaatgagatgatgccaggaggcatgatctgattcgattccacaatgggctgatgccagagctcaatttgattggatcctggatccttccatactgcgtctgcttcttaattcagtccctgctccttggtcttctccttggtctgggcacttctgttccccttgtggttgcatacttggttcatctgggcatgctcagtttacatgaccttcagcctgagggctcagaccaactcataactttgttggattaaagtttagccagatttgtctggcgctgttgcaggtagagcagttgtgacagagactatgttgccctcaaagctgaacatatttacagtggtgcacccttatccacaggggattccttccaagatcctcagtggacacctgaaatcttcagtagtacaggacaccatacatattgtgtttcctttacatatatatttataataaagtttataaattaggcacggtaagagattaacaacaatagctactaataacatagaacaattctaacaataagccagcatcactattcttgtgctttggtgccattattaagtaaaatgagggctccttaaacacagcactgtgatacctcaacagtcaatctgataactcagaaggctactaagtgactaacgggcaggtagcgtataaggcatggatatgctagacaaagtggtgattcatgttctaggagggacactactcaaaacagcatataatctaaacttatatattatttatttctagaattttccatttaatattttcagaccacagttgaccacatttaactgaaaccacagaaagtgaaaccatggatgggggaactactctataccatatcatctgtcaccttacagaaactgttcactgatcccttttgtagactaaagagtcataaagatttctcactatgtgagatagaataatttttaaaagcgtaagtttcagtttacacttttaagttccaagttccctctatgactgatcatctgactttgcatgagtcacacaagctgagtccagctgtccccagccactgagatgcagatactaacaagcacctctactcagttcccaatctgtcaagtgtgcagtgagcatctaaggtcaagaatacatttcaatgatcacaacagctggtgctgagaataccatcaaaatataaataatggccttgacaatgtaactgagaagactagtatatttgaaacatgggaggcaaactcaagacagaatataaatacatttaattactaagtcacgtagtaagttttggtatatccatatagtggaatattttagcaggcattaaaaatgatatttttcggccaggcacagtggctcacgcctgtaatcccagcacttcaggaggccgaggtgggcggatcacgaggtcaggagattgagaccatcctggctaatacggtgaaaccctggctctactaaaaatacaaaaaattagccgggcatggtggtgggcgcctgtagtcccagctactcgggaggctgaggcaggagaatggcatgaacccaggaggcggagcttgcagtaagccaagaaggtgccactacactccagcctgggcgacagagccagactccatctcaaaaaaaaaaaaaagatatttttcaaagaaatacgtttatggtggtttggttttaattgagatacataaatactgcttcaatttctgtaatggctgtgagatgttcctgttttaactcccttcttgggaaactatttctgtttgcagatgacataatcctatatctagaaaatgccatcatctcagcccaaaagcttcttaagctgacaagcaacttcagcgaagtctcaggatacaaaatcgatgtgcaaaaattactagcattcctatacaccaacaacaggcaagccaagagccaaatcacgaatgaactcccattcacaattgccacaaaagaataaaatacctaggaatacagctaatcagggagctgaaagacctctacaaagagaactacaaaacattgctcaaagaaatcagagatgacaccaaaaaatgaaaaaacatttcatgcccatggataagaaaaaaacaatatcatgaaaatggccatactgtctaaaacaatttatagattcaatgttattcccattaaactatcattgatattcttcacagaattaaaaaaaactattttaaaattcacatagaaccaaaaaaaaaaaaaaagcccaaatagccacaacaatcctgagcgaaaaacacaaagctggaggcatcacactacctgacttcaaactatactataaggctacagtaaccaaaacagcatggtactggtacaagaacagacacatagaccaagggaacagaaacgataacccagaactaagaccacagacttatagccatctaatcttcaacaaacctgacaaaaacaagcaatggggaaaggattccctatttaataaatggtgttgggagaactctggctagccatatgcagaaaatggaccatatagaaaaatcaacacaagatgggttaaagacttaaatgtataacccaaaattataaaaatcctaaaagaaaacctagtcaataccattcaggacacaggtatgggcaaatatttcatgatgaaatgccaaaagcaattgcaacaaaagcaaaaattgacaaatgggatctaattaaactaaagagcttctgtacagcaaaagaaactgtcatcagagtgaacagacaagctacagaatgggagaaaaattttgcaatctatccatctgacaaaggtctaatatccagcatctacagggaacttaaacaaatttacaataaaaaaacaaacaaccccattaaaaggtggacattcttttcactctaggaatctctgatttgtctctggcactttcaagaatttgtatttttctttgtcatctgatgattcattaaaatgtatcaaggtgttggagattttttttttcatactgcttgtagatttttttgctttccttcctaaattcatgttcttagcctattgtgactcggctatatgcaagaagtctggctcagccttcccaacattttatgtgtccaaggcctacttttactttcccctgagtagttgttaataccccaaactctgggtaacccaggtcagtttctgttccccaggcaactctagctcctgtactgcttttatctatttctggattgccatcagggcttccttgagagcttcacatttacttaaaagtagacttgatataatttcctgatattttgtagagctacaaggctttttaggaaacccagtttggccaattgacagaaatggaagtccaactttggtgggaaaactattattgtcaatcactttatatagaatgaaacagtggtgcagagacatgactttgaattatgcaaggtcaaagtgccaacatacttcagatgtagaacttaaagtcaacaaatctgaaaccaacgttaatgtgttcctcaatacttcagtgaatacaattacggatagcaaggtgagtaacctaaagcaaaaacaagggactactttactccttgtgtttcgtcctattccataacatagtttgtgttcttggaactgtaaacttcgtctttttaactacttgccacatggtaaaactgacaatcatgaaatatgtcacgttatcctgtgacttagaatgtctggtggggcatcactccactcttctggagagaacatgtatgacagtttgaaacattcaaaatgtgctgttctttgcagtcaggaaagaacttcagggcaggacagaaagaaatcagtcacaacatttcagatattggtgttagaaggagttatttagggagttatttagagataagacatacttcctggctctgttgaaatcacattgtgtaagaagctgcctatttcattaatacataaagccagccttcctttacaagtagaggctacattatccctgattatgctttatttttaaaacgtgaacttgaggaaagagactcaggcctgtatcatacactttccttagtttttgttttgtcagaagcatattattaacaagtagtctctttcaaaaagacaagatacaaacgagtagaaaaaaatccattctcttatctcatgatggttagattatttaagagttgaagtgattgctatgtcatttgcataaattcaaggacttttatttatttatttatttatttattcatttttgagatggagtctcgctctgtcacctaggctggagtgcggtggcgcgatctcggctcactgcaagctctgcctaccgggctcatgccattctcctgcctcagcctcctgagtagtgggactacaggtgcccaccaccacacctggccaattttttgtattttcagtagagacggagtttcatcctgttagccaggatggtctcgatctcctgacctcgtgatccgctcacctcagcctcccaaagtgctgggattacaggcgtgagccaccgcgcttggccaaattcgaggacttttctctctcaattgcttacaattaaaaattttgtagtagcacatgctcacagatttggggctttcagaaatgtcttttcaaactaaaaacttttaaaataaataatattgcagatatttaaaataataatatttctagattgcagaggaaatacaaactcccaattaatcataccaaatatattctatgttctttaacttctggtagaaaaaaaatcagatttatactttatatcttcctgtattttagaaaatagcagacaatgagagaagataattctctaatgagatatttgggatccaacacggaataaatgtctgtatcttaattttaaatttttactatataattattgatatcttttcctaaaaggggaaatcccttactctaattttgagattgatatttagaataattgctaaactaaatagtagacttgaaaaagctttgctcataaaattcttacagatttattttattttacagaagtggtaatggtaattaacaaaaattcttaagtgtaataaattcattttggtagattttggtatgtaaatgagaaaacagtcttctaactataacaaattatttagcttagtctgtcatataaaattcagtgaaaaactaaaaaaaagtaacaaaaaactgagcctattcaaattatatgtaaagtttgtgcacagtatataaaactaagttaagtaggcttacaaaataacacttcatatagtattttggggaaactctttctccaagaggagaaaaaatagccaaataggaaagagagtgcaaggtttttaatcaagtgtgtctcttcccttggcttgtgtgggaagattgtagatgggattactaggatcagatttagaacactgatctgatgtcaatgacctaagtcagcatagccagcaaagtaatatttccagataaagagagaaaaaaaattctcctagataagaaacaaacaacagggtgctctcaaaaccagcactgtaatcaccactgagctaattagtaggacatttaaggccaaggcaccatggaaaggccagaaagagacaaaagtcaataaaaatggtcactgacgacagagtcacagtgcctggctgacagatggtgctgaaaatctctgagagatgaggacgacttcagataagagcggtccagggaagatactcagtcattgacaaagcacaatgggaagggtcagtaaaaagatcaataacagaaggaaacagctgccacattcatcattcttaacgtcaaggttgacattggataaatggagttggcctttttttttcttttttttttttacaatagtttagtgcagaaacctctaaaaggagcttgtacatgaagaactgaagtgagaagcctagccatttgtataccttttagtaatagagactgaatattaaaacagacagtggccaaaccacgtacgacaatggaactctgacccacaaccactgcagcaaccagcttgggaaggcaaaccacaatctctgcagcagccagttcaggaatgcaagccacaaattcagtagcaatttgccgaaaacaatcagaggttggtcaatgactgccaacttctctaagattgcccctgcttctagtttagtactaattaaagaaagccaaatactctctccaaacctatcccatcagatgccttgcttctctttagcctacctgcgcctctccatgcccatagcctcctaccccaaagccttgccccttttcactataaagctttcccattctcccagcctgagtctctgtcaaacataaatgatagtgactgcctccctttctctagcaagcaagaaataaatagcttctgttctcattaagttgtctcctttatttctgtaattttctgtttttttttaattttttaatttttttgagactgaatcttgccctgtcgcccagactggagtgcagcagcacgatatgggctcactgcaatctctgactcccaggttcaagagattctcctgcctcagcctcccaagtagctgaaactacaggcatgtgctaccacacctgtctaatttttgtattttttgtagagacagggtttcaccatgttggccaggctggtctcgaactcctgacctcaggtgatccacctgcctcagcctcccaaagtgctgggtttataggcatgagccaccatgcctggtctgtatttctgtaattttcctagaagctccactgagacacattcttaactgctcatcactatggactttggaccctgatcaagtgcgctatctatggaggcctcttgtgccttgcttcttgaggcctgtcaagtctgtgttgacacagtgtctgtgagagaacagagttgggcttcaactctgttctctttgtattgagatccttggttattgactatcagcttggtactcagcttttgctaccaattcccatttgtttggcacccttggaaaaatactgccatttcttttcattcctttttgttctcttttgtgcttctgttttatgagatatgtctaaagtgttgtctgttatcagaaggagaatcagtgcagaacacaggctttgctcctctaagagtgtctcagcttgctccacaactgatgagctgcaattcttaccaaaccagcatccatctggacaaactttcctaaactttcctgtcagtcaccaataaaatgggataaggttcttcatcttttttttttttttttttttttttttttggccctgagaggttggatttgatgcagagggaatattctggttttccatttgcctgtgggcacaagttgtcaagtctgcatttggaggttgccaactatcaggttgggggcctaagacataaagtgcacaaatattactttcaactgaccattgccagctcccatggaattttctgagtgtaaatcctcttttcctttttttcctccagaaaaacctcccatttcttatacgtacccttgctacgatcctagcacttgcacccatctctataccaaggataatttaggccttcagtggctaatctggagaacattggacttgaacaaaattgttcatttgaaaaacaccttagaaaagagagaatatttctcaggggcaatgggcagcagtttttgattggtacacaagttttcaaatgaaattctgattcagacattactccgctaaaatattttttggccagagctaatgaacagtatgacaaacttaacaacaaactaactcatttgcccagcaaatcttcccccagcttctcctccagttgacttcagctctgcaactcttcctcatccccccatcctcctttcacacctcattgactcctccctcttcttccagaccccctaccttctcccagtgactctcctaagatcccggaatgtcatttacctctaaagttccatctcttcaatgacccaaatacgcaagcagcagtagaatttaaaccttgaacacgagctgaattaaaagctatgactaagcatttcccaaaggagttcagaattctaaattcttttagttgtacacaactcagggttacctgaactatatcaacttgtatttatgtttgtagatcctcagacattaaatcctgatggcaaaagccagttggattcaccaggacagagatctacagcatctttctttccacagtaagcctgagggccaaaaagaggctcaaaaagtagggcaatgtatcctaaaagccttacttgaaacatttctagtaaaaataaaatggaccacaatttaatcatgtaaataaagaaaagaagaaattataggagattttcagaataaactagaaaacccctttcaacaacatttgagtgttaaagaagtgtaagtgtaataatggctcttttacctactttgttaatggaattaaacctgaaattggagacaataattagatcaaaattagaatgggaaatagccactttacctgaacttcaacacctggctgacatttttgcagagccctaggacaataacaagacaggatccagaataaccttacggccctgcagatcaaacagttgagtggacgacccatagaagaggacacctgcagatattgaaaacagaagggacacctgaaaaatgattttccagtaaaaataagaccaaaagaccccttaatttagatcaatgaaggtacccaatatcctgatttaaaatttaacattcaaggtgaattaaccataaatataggtggccaacctcagcaattcctggcaatatgggcgctactctttcttttctttctttctttttttgttttgagacagagtcttactctgtcactgaggctgcagtgcattggcacaatctcggttcactgcaaccgcttcctgggttcaagcgattctcctgcctcagcctcctgagtaactgggactacaggcatgcatcatgataccctgcttttttttttttttttttttttgtatttttagtagagatggggttttgccatgttggtcaggctgctctagaactcctgacctcaggtgatctgcctgccttggccccccaaagtgctgggattacaggtgtgagccaccatgcccagccaggcactaactctttctacattaaaccctggcaattttgctcaacattttcctcataggaagcaagtagcaggtatctcaaataacccacagattccttctatctcctactgtaactacaacctttgggtacttgacttaaaaacatttctccctgctctattataacactcttgcaaatttaatggggagtaacttaattttcaaatagaattataatagtaagtgcaccagctgggcatggtggctcacgcctgtaatcctagcactttgggaggctgaggtgggtggaccacttgagtacaggagttcaagaccagcctggataacacggtgaaaccctgcctctactaaaaaaaaaaaaaaaaaaaaaaaagaaatacgaaaattagctggtgtggtggcacatgcttgtaatcccagctacttgggaggttaaaatgggaggatcacctgaacccgggacgcagaggttgcagtgagccaagatcacacctctgcactccagcccgggtaacagagcaacactctgtctcagaaaaacaataaatgcacagcagagtctcctgagggttcctctatatgtcatctctggatatacgtttgtctccttcattatatttgacatacgctccagataaagacctcaacactctacctaacactctacaaactaaaaaaatccatttatatgggaaattactggagcagaacctagtcaagttcagaagtatcctagtaaaccatggtcaaacttccctgatattccttgaaaaaccagaagcaaaggaaggcttcaaaactgtagttgacgaccttataaccaaagactttctcatacgctgcaatagcccatacaccacacttgttctgctggtacacttttttcatgacctcaggaaagatcaacaaaattgttttgctttgcttcctagtagtacctatcctgtcatcaattctgcccaaaaccacttgcttcaccatattgaatctttactgtgcatttttcagtgtgcttccaaaccagaacaggcaacgactttgccttcatctggagaggacaacaaatataccccgatagtcataccccaggggctcactaaagccccctcttactttccacaagtcctcaatcaagacttaaagatctaaatttcacttgtgattcggttttgatgcaatatatgcaggatcagatgatctccactgctttcttcagagaacgaggaagctggtgagaaggtgagagcaagtaaatacttgctctcagccatagcagaaaaagaacataatgtttcaaaagataaattataattttgtcaaaagacaggctagtatttagggcataagttatcttaagagggtgaaattattttgtctctattggtaggcagaacactatcgaaacttcacctcgatgcctcgcaaaatgacaattgagaggatttctagatttaactggatattgtagacaatggctgcgaaatttttctgagcttgcaatctctttttatgaattggccgagtccttagtaagaaactgtcttttgtgggggcccaaatataaattctgtaactcaagaaggctctccagtagcctcttcctttggtagttaggcactccctttcataattaggcacccctgactacaatatgccattttgtctaattgtgcgtggacaacttgtacaagcttttttgtttttaactcaatgtcatggaaaccatcaaaaattcatcattttccatagccttacccttgacccagctgcaaaggcttatagcccttgtcttaaggcaacagcttccactgcaacatttgttgatgcttcttttaaactatttctaggctccccacctcacatcatgattccctggccagtgtagacataaccactgacaaagagcatgcaatactttccaaccagctgatcaacttcttatgagagttttactccctctctctcgctttactattcactgatgcaattccttaaactgccactcttctccccctgccagaagaagggaacctcatgatggttataagtcagttaggggagtttccgtacctcactcagattgatgagagactgactctcattgtgaactctgattcaatgttattcattgatggatcatacctcaaaactgatattgaaaattatcactaatttaagctctactttagaatatattttctatctgaggtaaaatcaacccatataatggaatttattacacttactagagcttgtcaattagctgaagaccatgtagtaaacatagagcaggtatgcttttagagtactacatgaatttgggatgctttggggaaaaaaagaaattcatcatctctgctggaaaccccatgaaaatgaataagttaaggcactctactttctagagttggctattttaaggttgaggcccatacaaagaaagaaggtaatagaaaaactaaagaaaaaattctaacagaactttatgccaaaaaaaaagccttaactaaagttaatgtttttgtttgtttgtttggttggttggtttttgttttttgagatggattcttgctctgtcgcccaggctggagtgcagtggcgccatctcagctcactacaagttccgcctcctgggttcacgccattctcctgcctcagcctcctgagtagctgggactacatgcgcccgccgccacgcctggccttttttttttttttttttttttttttttttttttttttttagtagagatggggtttcactgtgttagccaggatggtctccatctcctgacctcgtgatccgcctgcctcagcctcccaaagtgctgggattacaagcgtgagccaccgagcccggcctaaagttattgtcttctgtaaatcttcaaaggagaagtttctaaggattcagataggccattataaaatatcagtgggtcaaccccagtttccaaacggaagtctggaaattccacctcagactggagcttccaaatgtggccacccttgattattcaggcagtctacctgggggagttactgactcactgtgtgaataatcagagtgagaattgtacaaatagaaaaaaactgtaagaaaaccatcaccaatagttttatcaccaataactctggcagaagttaatgacattgtctcttccctatacgaaatataaatcagcctcaattcattggtacaagtaataataaccacatttctctagatttcttgttggctactcatggtagctctgtgttattgctaatacttctcactatatttgaatcaacgaaacaggcaaagtaaaacaggctctacatctcacatttccttatggaaaaaagataattgccattctaaggcagatcttcaaggtctgtggcctatatgttctcttggtctgggttggaaaattagaatttctgcttctgtaacattttatagggactagtgattatttttgtttttgaaacccgacctttaagccaaagacagcctgacccctgaaaacccaactgccagttctaggtagagtccacaaccagagtgagaacatcctctatgccttttaaccaataaatggtgctttttccaagacctcccccggcccaatcagcatgcactcccccattctgagcccttaaaaatcctatactcagccacacagatggctgccggctttcaggccccctttcacacagaagtctacccacttcaggtcccctcttgtgttgagagcttttctgccgctcaataaaattcttctctgcctttctcactctctgctgtccacacaccttattcttgttggttgtgggaactccccaagctgcgggtgacagtaacaaaggagatgtaaggcacccctgttcactgggctgcaggcagcaggaaccagagagaactgtaacatttccagggggctcagacctcaggactccccaagcaaaagctgtaacaccctttggggctttgcagttgctgtcatctccaagtattctggcgccaccacctccccttcatctagataccagcgcccaatatggaagccaattgcagcatgcccagtccagctatgagctgagcacgcagccacactgaccacaggatctgggccagtaatgtgagccaagcgcagcctgctgggccaagtgggcagagcaacccagcaggcctgagcaagggccggaacagaagtcagtgcagccacagagatttccagctggtgaagcggcactgaaggaattcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaagcttaatgggggaaaagagttatcagtgaggccttggggcaggggactgactccactgggcattacttgtgcaaaagggataaaatgtagagagagttttttttttctggtatattattttattccattaaagtcagtgttctacttttattttgtaaaatcatatttctgagtcctgaacaaaagactttcaagatagattttactgacagagaaatggagtgccacattccatagctttgcatatagagcttcacatgcaaagctctttgcatctcaagggctaaaacaggctgacttacagcaagtagctttcctgtaaactgtaaagtagaagagaacggagacagctatgaaggtgggaaaaatgcctcctgcagaagaagagcagacataggggagcataaatagtataccctgcctggaccctgagaaggacccagacccgcatggtgcatattgagagagacatggctgtggatgctcattacttgggattctcagtgatgcctcaatccacaattttgtattaataaaaaagtctttaaaatatttgcatctaggaatcaaagtgtcattcaatgacttattggtcctcaaatgacagcttggggttataccttattttctatatcatggagtaactcctgcactatattcattctaggagaattaactatgtcaattcttatgttcatctcttccttggctgattatttgttagggaaaaagcttttgcttgtttattaacttgtctccttcctactcttctgattattattttgtaattaaaacaggattttaaaattcatagacactaaaatattctagacttttagcactggtttctaatattttgggaggagaagcttcattttttcttgaaaatgaaggtgtaaagatactaaattccttgagtggaacatctgggcttcatagaaactttggagctatatgatagttagagagaatgtagacagggttcctcattgtatagataatgaaacaggaccagagaggctgagtgacttgtagaaggtcccccagtgagtagcagatcctggatgcatgcagcattgctaactctgagagctaagtcctcatcatgtccccaccttcaccacaccacacagttcaggagaaggggcacatctctagaatatggctggaaaatacactagggaaaactttagatccactagcagagtccagtgctcctcttggagaaagtgaccagaaagaataaggcacagttagctgttgaagaaaagctgatttctcagccagattatatacattagcatccatgttagttacctttgctgaataattctctcctcaactcagctctctgaagaaacctccaggaattagcagggctttgagtagagatggcatatgtttgggccctgatgaaaatgataaaattgtggcctggttgcagcttgtgtgctgaaggaagagcatgatgcagttcattggtatgaaaaatgaatgcaactaaaacctaaacattaaaacttggcctttattaccaaagtgaaagtgcttctaattgaggctccctgggttttaattgttcttcaggaaaattagatgttgtcaaagtagaaggttaatgtctgttcacagtctggagtttttggaataacttccttcacagcgtgtgtgttttaaacataaaaagggctttttggtttgtatatagttagtgggattacgactgcctcactagatgtttacaacaaatatttaagaaatccataagtctactatttataacagaataaacatttaaatgtaagatattttgaccattttggtaaaacatttaaaaaataaactatcatgaactgacaaaaccaacatcatttaaaaaaattcaacatggcaaaaactttatgagacttataccatagaccaaatttgtaactttagccttgatacattactgcttgtaaatagaaatgttcttactatgaagtgatgtgctcagatacacccaaaatttattaaaggcatgtcaacagccaaattctgtggtacaaggtttttcatacattattttacataacctttgaggaattccaattttatattcccattttcagaagagttggttagttactgaattcaacaaatgagtgtgagcaggggcctggagtacttaaaaagaataaacaaaatgcctttaaatcagaaagacaaaattgctagtaatttcagttaattgcactttactccatgtagctacaattgtagatatctagaaaaaatatctatgctaaaagtctgccatctggaaaagtcaaaagaatgatgagctggtattaaatctcagtaaccctggcatatggagtatctctgccatgttaagagcagaccttggtatgagactgactctgggctttacatatgaatttggaattgccaatatctccacttgaactatgtgagacaataaaagtgctcccttatacactttagataatgggccctttgggggatctgatgttcattctgcctttcccagaaaaatacaactataataaaatgttgtaatcagtttcagtttatttattgctgatcttttatttttgttttaatttaacatggcaatccactttctatagtcaaaagtgcaatttaaagaactctaacaactcacaatatagaagaatgtctttggaaattttaggattcaaatctaaaacaaatcttaagatttctttttcctagattgtactgatgttacaagtgccttatgtaatacccagttcttccccatggagatttctcagtgaaagagccacatcacatgttcacaagagcatcaagaataagagggccacgtacctaggaagaaagattggcaagcattctctctcccccatcaaatataaatggatttagcacagggatttggtttaattcactgctgccagcacctagaacaatgcttgaaatttttaatatgacaatgcacaattcaagaggaaataataatattgtattagtctgttctcacactgctataaacacatgcctacgacttggtaatatatgaagaaaagaggtttcattgactcacagttccacaggctgtacaggaggcattgctggggaggcctcaggaaacttaaaatcatggcgaaatgcaaaggggaaacaggcacatcttcacatgactggtaggaaagagagagctgggaggtgctatacacttttacaaccatcaggtctcttgagaactcactataatgagaatagcaatagcaagagggaagtctgctcccatgattcaatcacctcctccaacattgtggattacaattcgatatgagacttgggtggagacacagagccaaaccatatcaaacattagtacgtgaaagtagttattatgataaaacatattttaaccaacatacaattagttatatgatttttataatgttttcagtgttaaaatttttgaaaaaactgcagaaaaacaagtggaagtgaacaaaattacattgacagtagtaagttgtaatgtttaattcttttaatgtttcagtgggagctagaaattggtttgatatactttttagttcagttggaatactccacttctccactttgcctaatatatgctgcagcaataaattaattttccttctgagatttctaataatttggggagtgcttatttgcaaagaattgaaaaaaaagtgacacaaattgatatatcatgcaaactatgtggttttgtattttcaactaattgctgaagagcacttatacgcaaaaaatatcagattcctcaaagaagagatatttaaggcaagtaaagaaatgtataggtcagtttccttcaaataattttatttcttactcttaaaaatcttttatttcagattcaggggctacatgtgcgggtttgttacatgggtgtattgcatggtgctaaggtttgggcttctattgattcccttacccaatactaaacatagtacctaattggtagtattcaaaccctgctgccttttctcccaccctatttttggagtccccggtgtctactgttcctatatatattttccagtgtttagctcccacttataagtgagaatatgcagtgtttgtttttctgtttctgctttaatttgcttaggaagtggtccccagctgcattcatgttgctgcaaaggacatgattttgttctttttatggctgtgcagtattccaccgtatatatgtacaacattttctttatccagtccattgttgatgggaacctaggttgattccatgtctttgccattgtgaatagtattttgataaacatatgagtgcaggtgtctttttggaagaataatttatttttctttgggtagctacctagtaatgggattgctgggtcaaatagtagttttatttttagttctctgagaaatcatcaaactgctttccacaggagccaaattaatttacattctctccaacagtttataagtattccctttctctacagccatgccaatatctgttgttttttgactttttaataagagccattctgactggtgtgagataatatctcattgcatctttttgataattaacgatgttgagcatttttttcatatgcttcttggccacttgtatgtcttcttttgagaaatgtctgttccttttgcccactttttaatgaggttatctgggttttctgttgatttgtttaagttctttataaattctggatatttgttttttgttgggtacatagtttacaaatatcaaatattttcaatctggaaacttggatcttttatttttatgatgataaattgaggcatattgcaagaaaaacatttgaatcagaatatttaccaatattatcataatagtgaattatatttttacttgtccctacattttggtaataacaattaaattttgctaaataataattaagtgctggtccaagatggtggactgattattcttccagggggccaatttcaatgacaataaatgagaaaatgatgtgaatcagtaacaatactaatttaagctaatttctatatttctatagtgtacatgttctttgaagcaacaagtatctatcactgtaagaataagacatttggaaaatgtcttatatatatgagatatgtcatatatatgtatgtaaataaaccataacgtttctgtggtatatgatgtgagctattttcaaatatgtgagttccaacctccctctgttaaggaacatttaactttcagtgattcatgtcacttctgagaccaactgtccccagcctctgagattcagataaaaacaagtatccttagctctagattaatccaatggcactgagcatctatggtgatgaaagatatattttcggtagtcattttaccaaagatggtgctgtgaaaaccatcaaaatataaatcatggccttaaccatctatctgagaagacaagactaatacacttgaaacacaagaaacaaatgcaagagaatataaatatacttgtcattgaattttgcaatacagcctacgaatgttatagaggctcatctaaatgaggaagtcaatgatgcatagtataatcaagatatgcttcctagaatacattgtgtagatggatttgaataggcagatggataaagatgaacatttaagacatgagcaaatgcctacacacctgaaaaaatgtggcaagtctgtataggagagaagaacatctctgagggcttgagctacagtgtgataaggagctcatttgaataatctggtggaatcagatgggctatggaagcctgatggagtaacacaagcagataatcagcaaagatgcttatcagctctaagaaggactagaaaaaaatttcagaatataaaccaaggaaataatttttaaatgtataaaatttaacctaaatataattctataatgtaaacagaaaaaaataattgactggaaactattttcatcaaatatgaacattataaattactctcatgggttactcaatgtactttaaattttagacattttaaaatgattcaatttttaaatttgtctttaaatttatatataatatatttgagatataaaaaaaccaaactatttttcttagtctcacacactcaccactcaatacattacttcacctctggtcaccaaaatatgtatggatttttccccgcatgcaaaggaattctccagcagacaccaccaggttggcctattattgaattcaattctgacactatctacttggatatagggtcagatcccacacagtaagggcacagtctcacaggacttcccttcactttagatgccaattgcaggtcccagaatgtgacctgtacttctggccaactggctataaattggaggttcccattaccccctgtttaggttcaattaatttgctagaatggctcacagaaatcagggaaacacattatttacatttactcatttattacaaaggatgttactaaggaaagtaatgaacagttaggtggagaagctgcatagggcaagcttgtccaatctgccttattttgttgaggttgttgttgttgttgttgttgttgttgttgctgtcctgttttgttttgctttagacttttagcaacctgaagccatggtttttagtttctgtctatagtgataagcagaaaagaggaaggaggaaggggctttactggcccaactgggaacagaaactaagaacccatgactgtattccctcccttggacatcactgaaggcatgagagaaggtgtagggagcttccgtgccctctctggtatgccaccctcaggtacctccatgtgttcagcaattcagaagctctccaaactgattttggggttttatgaaagcttcattatgtagaaatgattgattacctcattggccattggtaatcaactaaattttcagcccctttcctcttcctggggaataaggggttggggctaaaagttcatatcctctaattacatggctggttttcatggcaatcagctcctattctaaggctatccaggagcctaccaagagtcacctcattacagcaagagatgctcctataatccaggatattccggggatgtaggagctctgtatcagatactcctatcactcaggaaattaaaaagttcttcggagctctgtgtcaagaaccagggtcaaagaccaaatataagaacaaaagatactcctagcatccctatctgcaagggttttagaagctctgtctcaggaatcagggacagagaccaaatacataatttttattatatcacaatatcacatggcataattcacttttatattttgtatatagttcaataagttttaccaaatgcatgaagtaatgtagctaccactacaatcagtaacacagaatagtctcatcaccacaaaacaactctccctggaatcccctttgtaagcactctctactgatatgtaacctctagaaaccactgatctgttttctgctcctataatctggtgtacttcagagtctcagaaaaatgtgataataggaaatgaatgataaaaagctataaaacctacagaaaacaaatagcagagtgccaatagtaagttcttccctttaaatgtaaatagattaaactctgcagccaaaagatatagattggcagaatggatttttttaaaaaaatccacacaggatccaactctattctgtctataataaactcactttaaccctaagtacaagcacaggttgatagtggaaatacggcaaaatatattctatgcaaatagtaataaaaagaaagaagggtgcctatactatcagccaaaatagactttaagtgaaaaactcttataagagacaaggaagggcattatataatgataatagaatcagttcaccaagaagacataacagttttaaacatatatggaccaaacaccagagcttcaaaatatatgaaatattttcctaaatcagagtcatggttattttctcctagattatcttgtaaagttttataattttacatttatgtctataatccatttttaattttttataaagagggagttataagtagaggtttatttttcacataagatgccaaattattccagcaccatttattaaaaagaaaattctatctgttctttgatctttatcaaagatcaattgaccatatatgtgggcatcagtttatggattctctattctgttacattgacctgcatgactatcttgattactgtaacttaagtcttaacatcagatagtgtgattcctctaactttgtcattttcaaaattattttagaatttttgcccctttaccatgccctatacaatttaagaatcagtttgtgctttatcaggataagaaaattgcctttatttgtactttgctgagagttttcataataagtggatattcaattttgtcaaacatttttatgtacctagttgtgtgactgttagattttatcaaagcattgtaagaaaattgctatgagtaatgcagaggattagctcttcttgttattcccagatcagccctatattttgactggaatttttcatttcactaatatgtatctagaggactgtatattcttccctatttatttaagcaattatttatatacatttagaattaaaaataatttaatactttgggatataattcaatactactttgtttattttattgcacaaattgttctagttttggccactgggagttctttctgttggctcctgtattcctttgatatacccccatcattgagggttttttaaatgtggtttattattaatgaaattaaaatgatctattcatagcacctgagatgatttcagatatcatattatgcaagcattaagataatattaagaattagactggtaaatgaaaatcatagaatcagagtacttactcaatgtcaagttttgctaataattgcaatgacacaagcagttataagacacaagtgaagcagaaagtgttctgggaccccaatgtgacttattgggtcatttcttctcacatgagatgtgttctggtacagatcttgcacagaagaagccacttaggtcatgaattactgagttacatagtttatgtgacattttccttggagccatcccctgtaaacctaaagattccaggtctatttacacaggtgattctagataggcagctatattttactatatgtatttcatagttctctcttgctagccaaggtcacatactttgtttgccaggagagctgccattataatgtttacaaggcaattagacaagataatatgctttctttcttcctttgatgcatcacccaaactctgccatgagagagaagggcatgcaggtctacttcataagtcctttctttctagatattctggtacagtattttaatgtattttatgatacagatactctagcacttaatatattttaatgtatcatgtttaatataagctcgataaagaatcatcacttcacatactttggataataattgtacacagtgcaaattcatggagaaaataatcagaaccattaatgctgataattttggggcatttaaacctttttcaggtcaatggattaatagatttattagctcttgcagagtgcaagcatattacagatttatagtataagtggttaaaaacatttttatttcactgaaaattcatgtaaagtgaagcttttgcaaaactgtaacctttatgcttttaataaaacagtatttctgttgtacatgataatgattttgttctagaacactatgtataagcagattttgaattgaaggcagtggagcaagtctgtcaaaaatcaattcaattgatttccatttatgtagatgcattgagttttacagtggttgaagctctctttaaattgattggattcagaatgcaggccagtggtccgcatccatattctacaccgtttctccaaaacttggtaaagaaaaatgctttagaaactttcctgaacaaataatataaagatcataccaactatatgttaaccaattagttatgaaatctaaaatcattagggttacatttcaaaagtgaagttactaaaaaggtgaaattcaaatctaatagaaatagggtaaaatgcagaacatttatgaaacataaaagagggactatctgtgttagcaattaagggctgtagcaatttctgatatcagattccaaatttgaagagatccagacacttcatacacaggtttattttgccctaatattttgtcttattgagaattgtggtaaagagagaagacctgagtttcattcttataatggtttgagacatgaggaagtcactgaacatttctggacgtaactcacttgcatgatttcaactatcacatatacttggatgcttgaattacaaacctatgtagactagactttcctgctaagctgaaaagctgtatatggacatttctttcatgttagctccagttgactgtttctcaggtactttcaatttcacatgtcccaaatttttctgattttcctctggcctctgaatgccctttctctgtgagcagcatcgtcacacaccttgtcacccaatctcaaaaatggaaagacaccttccaagtagcctcttctcaccacccttatcctattccacaccctgtttcaaacactgtgaaggtttttggagtagctgttcaaaggacctaccacaattagtttctgaaaagaacaaaaaaattactagctccagctggttgaccatcacaattgagatcatgcttgattctgcctctgatgtaagattttcattgctcaaggcagtcaataaattttgattcttaaagacacactctgataattttctgtgaagtaggaaactcactcaagaagaccagcctttgagtggtatcacagtctagactttaaatttataaggtggaaatgggctgtagttggaatagattcttagctctgtggattctatttctatcacagctctcctatccacctccctctccgttgcccatgaaatggcctaaatccaggcctttaacactttttatttgaattattatggaaatagttaactgtccttactgcctccagacatgcttccctctagcttcctccttcatattgatgtgcaatgatataaactccaaatctgatccaaatctgctgaaaagcctttaataaatgacttcctacattttttcaggaaaaagtttaagttttgtggctcatcacataccacattttttgaatgaatatacagtaaaataaaaagtagtagaaataccatttgacccagcaatcccattactgggtatatacccaaaggattataaatcatgctgctataaagacacacacacacacacgtatgtttattgcggcactattcacaataacaaagacttggaaccaacccaatatccaacaatgatagactggattaagaaaatgtggcacatatacaccatggaatactatgcagccataaaaaatgatgagttcatgtcctttgtagggacatggatgaagctggaaaccattgttctcagcaaactgttgcaaggacaaaaaaacaaacaccccatgttcttactcataggtgggaactgaacaatgaaaacacatggacacaggaaggggaccatcacacaccggggactgttgtggggttgggggatgggggagggatagcattaggagatatacctaatgctaaatgatgagttactgggtgcagcacaccaacatggcacatgtatacatatgtaacaaacctgcacgttgtgcacatgtaccctaaaacttaaagtataataataataaaagaaaaaaaagtagttgaatgaatatagagtaaacaaaaatgggtgggcctcatgcttctataaaatacaaggctttattaggtaaattaaaagtttcttaagcttccaacattttcttattccacaggaagctgtaaaattttctgcactggatccacactttgtctttatattctcctctcagcacaccatttcccaatatttggtaacccacaggttagcatcgaaaataaacaagtcagggtggctggcaaggtggccaaataggaacagctctggtctgcagctcccagtgagatcaacgcagaaggcagaaggtgggtgatttctgcatttccaactgaggtaaccagctcatctcattgggactggttagacagtgggtgcagcccaaggaaggtgagctgaagtagggtggggcatcacctcactcacgaagtacaaggggttggggaactccctcccctagccaagggaagccatgagggactgtgccatgaggaatggtgcattacagcccacgtactatgcttttcccatggtcttcacaacctgcagaccaggagattctctcgggtgcctgcaccaccagggccctgggtttcaagcacaaaactgggtggccatttggacagacaccgagctagctgcaggagttttttcataccccattggtgcctgagaatgccagcaaaacagaaccgttcactcccctggaaagggggctgaaaccagggagccaagtattctagctcagagtatcccacccccacagagcccagcaagctaagatccactggcttgaaattttcactgccagcacagcagtctgaagttgatctgggatgcttgagcttggtggggggaaggctactcaagccatcactgaggtttgagtaggcggttttcccctcacagtgtaaacaaagctgccaggaagtttgaactgggtggagcccactgcagctcagcaaagccactgtagctagactgcctctctagattcttcttctctgggaagggcatctctgaaagaaaggcagcagccctagtcaggggcttatagataaaactcccatctccctgggacagagcacctgggggaaggggcagctgcaggcacagcttcagcagacttaaacgttcctatctgccagctctgaagagagcaatggatctccttagccctgctaagggacacactgccttctcaagtgagtccctgacccctgcacatcctgactgggagacacctcccagcaggggtcgacagacacctcacacaggagagctctgattggcatctggtgggtgcccctctgggacaaagcttccagaggaaggaacaggcagcaatctttgctgtccggcagcctccgctggtgatacctgggcaaacagggtctggagtggacctccagcaaattccagcagattggatgttattggtttatagaaatgctactgaattttggacattgattttctatcctggaactttgttgaagttgtttatcagagctgggacccttttgtcagagactgggattttctaggtatagaatcatattatctgcaaacagagatagtttgacttcctcttttcctatttggacaccttttatttccttctcttacctgattgttcttgctaggacttccagtactacaatggctaggagtgatgagagtgggtatccttgttttgttccagttctcaaggggaatgtttctggattttgcccattcagtatgatgctggctgtgagttgtcacggatggctcttattattttgagttatgtaccttcaatacctagtttgttgagggtttttaaacacgaaaagatgttgaatgttattgaaagacttttctatgatgatcatgtggtttttgtttttagttctgcttatgcaatgaatcacatttatggatttatgtatgttgaaccaaccttatatcctaggaataacgcctacttgatttagtagattagcttttcgatgtgctgctggatttttgttgaggatttttgcatctatgtttatcagggatattggcctgaagttttctttttccattgtttctctggcaggttttggtatcagaataatgctggcctcatagaatgagtgagggctcagctcaggctctttgttcagtccccagcttgcaggcagcaggggcagggaccttggcagtgacaatgttagagggccttacacttacctcttggagctccaacccagagaaatgcagagcctctgctaaccaaaatgatcagcccggggtggagtggctatgtcacacacccaagttggaggccttgcctggtggtgagcagggggtgggggcttacagggaagacagtctggcctctttgggaaagagcaaagaacctgagtgcctgtggtatgctggaggtgtaataaggcactcaggttctttgttctttcccaacctggtggcagcaatagcaggcaccgctgtagcagtggtgtcagagggatcgtcagttgcctctgagaactccaccccagagatacatgaagctactgccaatgggaatgatcagctgggggtggggtggctgcatggcaggcccaatccaggggccctgcctggtgtagagcagggggtcaggggttcacagggaaaagagactgggttcctctctgtaggacagctgcagcatgctggaggtaccagcaaaacagtcaggatctttgttctttccccagcccgagggcagcaagggcaatatccccgcagctgagatggtagagagcctttgggtcatctctgggattttctctccagataaaagcagtgccaccactgactgaagtgctcaggcgggggcaggatgactgtgctggggtccaggttgggaagccctgcacagtgaggagtagcaggggcaggaatccacaggggaaatagtctggctgctttcctgcatggcagctgcactgcgttggagacacatgatagtccttaggctcatcacttactccctctgccgcctcagggcagtaggggtgggggctgcagcagcagcaaaaaggcggaactgtcagttaactctgggagctctggcccagggaagtgcagagtcactactagcctaagtgttcaggcaggggtgtgttggctgcgctggggacctgggcccgtgggctttggctggcaaggtgtggcgaaggtaaggcctatagtctgtctgctcctcagcactgtgaaagcagcatgtatcttgggagcgtgcaagagggcctggcctcacctgctggcagagctatggcagctgaccctgggatgctcaggagcccaaggcccttgaggctccatatgtgcctgagtggcagctctgcccagactctgcacagcgctctgtcagtctggaggccctggagagagagggtcaggggatctcctgtgcccaggattgcagagatccatggcaagagtatgggctcctgggggctctttcccactcacactttccctgtggtgagaagccttccttggctccatgcgaatcccaggtgggcagctgccctgtctcactcttctctcttctctctgggttttgttgcttccttgatgagtcccaacgtgtcctcctgggcaatccagttgaagaggtagtgtttattggccattctgtcccttgatattacacaacccatctgagccatagtccttcagccacatccatgaccaagtgcctgggagatttaaataaactcggtgctctgcttgtgtagtaaaaacagactaccacctaagctgagatttttaatcatcacttatggaaaggatatccatgaaagtccattaaaactatgaatatatacagattgaatatctgataagacacatcttgaaaatatgtaaatattttgatgcataatgtttaaggaagaaaagaacagagacctttttttaaccttttcgtcctatgtgatatctgtatttagaatatagttaactcatctgcaaatccgattccaaatgatagagaaaaaaatctatgttaatttttccccatttcacttgtattatttggagatatgtaatttctaaaaggcaataggcaatacaatgatattttaatttttaaaaacaagcagcttttttttttttgcttttctcacttggaatgccaatcaacaagggttttttggttttttgtttttttgcttgtttgtttactctacttataatgaaatcaagtagtttttctgaacagaataatatgtttaggggaagaaatagcttataagattattgactgaatgtgaaactcaaacattaaatgagatgaaaaaactaaattagttattccctgagacaaacagggatgggagaacacctctgggaggcagctccttttcctcagttttacttatgtatttagttcaacatatccacacatagtgcttatcatataccaggtactattgtaaaatacataactgttgatttactgggttctcataactccctaggaaggttatttttatcattttgcccttttacctgaggtaagtgaggctcatacatggtgtgatggttgattttatgcatttacttgactgggcatggggtgcacagacatttgatcaaacattcttctgggtacttccatgagggtgttttctgatgagattaacattgcaatcagtagactagttaaagcagattgtccttcttaatgtgagtggccctcatctaatcaccagaaagtctgttaagtagaacaaaaaggctgattcttgtgcaaataagaaagaactcctcctgcctggcggtttgagcttggacattggtgtcttctgtcttcagactcagctgaaacattggctcctcagactcacactggaactacaccattggctctcccaagtctctagcttgtcagttgcacatcttgggacttctcagcctccataattacatgagccaattccttatcataaattttcttatatatatgcatgtgtacacacacacacacatgcacacatatgcgcacgcgcacatacatgtgcacgcacacacacacacacgcactcacatatacacacacaatctgtttatccagaggactctaatacagggagtaagtgtctcaaggccacatagttacaaagctcacccagggagtctgactccagggcccatgctctgggcatcaaatatcactcaacgttcacataaaacctaatgtcttaggcacattacatgtatagtaagtcataacttaatgtcattgataggttatttgaaattgcaactttaagtgaaaagacatactgtatgccataggaacttaactcttatttatatcaattagcatatggtaaaattggttttgttatatagtacaatattttacttaaagttgcagtttcttttttttttttttttttttttttgagacagagtctccctctgtcgccccggctggagtgcagtggctcgatctcagctcactgcaagctccgcctcccgggttcatgccattctcctgcctccgcctcccgagtagctgggaccacaggcacccgccaccacgcccagctaatttattttttttgttgtattttttttttttagtagagactgggtttcaccatgttagacaggatggtcttaatctcctgacctcgtgatccacccgccttggcctcccaaagtgctgggattacaggcatgagccaccacgcccagcctaaagttgcagtttctaagaacctgtcaatgccattaagtgaaggcttactatactcctgtgagatcaatactaatatctcaatttgagaaatgaaaaatttgagtctcagatgatttaagcaaaatacccaaggttacatagttctatgtagctgaggtagaacttgaacccagatctttgtggctccaaacaccattttctttccaatttgccttctgtcagttatctacttttaattaatataagtatttatctacctttaattaattactatgcataatcatgaaataagctgaattatctctgcattttaagatctagataaaatgggtttaataccacactggtggaaaatcccagtagccctcctgcatttatgtgaatttcagattccctgactctgaattgacaagttttctaaactcttttttctctttgcagcatctagaaacttcttacttccacatgaggaatacaatgtcatttgttggattttcacatgacaacaaaagaaaataataaacaagaccttgcttgcatggaaaattcattgcctattgtaggaaaaggcagggatgtcattacacagagcaaagaaaataacagaggttaatcaatgttactgctagcttgctcttatatatacttattttcatttctgatgcttttttcctctcaagggtaaaaaaacaaacatcaaatctctataaatctctcatgcagggcacccagctttctgcagctctgtccttctttggtttgtaatccacacttttgaagcccgtctaagtgcattcatagacaaggccatctctccccttggcctttgactgtggggcagggtgtaaaaagtgggaggtgggttatatgcttctagttgggtaaatgctaagcgtttttatgtgggttgcattttattttcgctttctaacaacataattgaacattcagaaagggtaagtaactttccaaaagtttcacagatactgaaagataagttagggttcatactttggtctgtctgatcacaagccagactaagatttgaacttctctgagactgtttcctcaaatttaaaatcagaatcatgttatctaattcactggctgaaccaagctcattcctcacccattttttattggtacttcttaaagaatgtggtcctcactctctaggttccatgttttgagcataaaattcctatccctgtaccccaggcagagaggactggaccaggcgtggacctctgacctacaagatccaaggcattacgtttgcctggttcatcacctccttcaattgtagatgctgcagatgctgccctctctgtagaggtttaagtaaacaggaaagaatgtttaatgaaaataaggggaacaaagaaaccatgtggagtaaaagcagagatgacacatcaggaggctacaaatgaacaataagtgaaacattagttcctggacctcaaaccttgatgccagcattcaggaggcttcctaggcaaggaagtaaattggtgtgaggtgactgaactgcaagatgaggtggaatttcaacattcaggctgccctctctgcagaggtttaagtaaacaggaaagaatgtttaatgaaaataaggggaacaaagaaactatgtggagtaaaagcagagatgacacatcaggaggccacaaatgaacaataagtgtaacattagttcctggacctcaaaccttcatgccagcattcaggaggcttcctaggcaaggcctgtcagctgtcctatttcttccactagatttctttcttttgttttgtttaagctagtttcaatgacaggcaactatctcttgtaatgaaatgatcctaagataaagtgttattgtaaagttcaaatgtaattagataaggaaatgtgcgtacatgtggttagcacatatctagaaaacgatggttattaaagagtaactggttacaattatctcaatcttatcactattaaaatttccccaaggtcagcctgcttttttcaggacaaggattataatatttcacgagattcaaattagtcgtatatttttaatttgaaaagaaaactacaaaagatgttataattcagtgtaagcacattttatagcaaatttattgtttgatttcattttcatgttatattaaaattttttgtatcagtgcttgtccaacatggtacaatggaaacaatcacattggaataatcaaatttttgaattacttataatatgctctttcattttaccagattttttgaaataaaaaatgaatattgaagaatattcatagtatctatagctattttctgttcaatttctgaaagaatgaggaatagtagcttttcaaaagctggattttggtttttgtttaattataatatcattcaaaggactaataaagactaaaaggaacaatgactttattgtaaagatacgtatagactgactcttcaaagtcaccatgaggaaggctgcactgtggctatttaaatgtaaatatatttaaattaaacaaaactaaaaatatagttttttagttacatgagccacatttcaggtgctcaatatgttgctaccatattggataagtatggaagatttccttcaccccaggaagttctgtaaagcactagctttctccacatctttctttctttattaggcattgttttccataaaattttctacctgctatgaccactcaaagccctacttccgtctcacccatgggcaaaatatccactacagtggccatttacctttttgttaaagtcacagaaagaatgtagtaacactctgttattttttttaatccaacaacctcttttaattgtgaaactgctgcctctgactacaagcatgagcaattgaccaggtctaatctcatcaaccatggctccttatattccttactctagttgtgagtccaagggtaggcatggaatcgtattaggatcatagaccctctacgagattatactattccaatattggggcaagataggtctctcttgcttttacttggaacaagtgatcgatggagatggcagaggccatcttggcaccatagggaaaaggcctgcttgagaatgaagctaagcaaatgcaaacagtgctgagagatgtggcattgttcctaaatctcaatgtgtgaaaaaaccaattcctttagcttgaatgtggttacagctgtttgcaaccaaaatatttctgaggctgaggagggaggattgcttgagcccaggagtttgagaccagcctgggcaatgtagcaagaccctgtttccatgaaaaaaaaaattacctgggcctggttgtgtgtgcctgtagtcccagctacttgggaggctggggtaggaggatctctcaagcccaggaagtcaaggctgcagtgagccatgatgacactgctgcactccagcttacgcaacagagtgagaccatttaagaaaaagtgtggttaatatatgggtattcgtgcattttatgacattgtgtattaaaagatacatatttacaatactacattatttaactctctaagtagatttctatgtagtataatactgccattatgttttgtctttgacattgcatattgtcaattttattcagtttatttagtgcatactttatgtaaggtactctcatattcaaaaattcttctaataaaataaatggacaaatcaagaatgtatcaaagaatatgagttctgtcttgatcattggtatagtttggatatttgtgccctccaaatctcatgttgaaatgtgatccgcaatgttggaagtggggcctggtgggaggtatttgcatcatagggatgggttcctcatgaaaagcttggtgtcggccgggcgcggtggctcacgcctgtaatcccagcactttgggaggccgaggcgggcggatcacgaggtcagaggatcgagaccgtcctggctaacacggtgaaaccctgtctctactaaaagatacaaaaaaattagccaggcgctgtggcgggtgcctgtagtcccagctactccggaggctgaggcaggagaatggcgtgaacccgggaggcggagcttgcagtgagccgagattgcgccactgcgctccagcctgggtgacagagcgagactccgtctcaaaaaaaaaaaaaaaaaaaaaaaagaatagcttggtgtcctccctgtggtaatgagtgggctctggttgtattagttcacaggaggtctgattggtaaaaagagtctggcacttcgttccctctctcgccacctgagaggccaactcccccttcaccatctgccatgattgtaagcttcctgaggcctcaccagaagcagatgctgatgccatgctttttgtacagtctgcagaactgtgagccaaaataaatctcttttccctataaaccactcagccttggccggccgcggtggctcacgcctgtaatcccagcacttcgggaggccaagacgggtggatcacaaggtcaggagatcgagaccatcctggctaacacggtgaaaccccgtctctactaaaaatacaaaaaaaaaaaattagcctagcgtggtggcgggcgcctgtactcccagctactcgggaggctgaggcaggagaatggcgtgaacccgggaggcggagcttgcagtgagcggagatcgcgccactgcaccccagcctgggcgacagagcgagactccctcccaaaaaaaaaaaaaaaaaatcactcagcctcaggtattcctttatagcaacgcaaaattgactaatacaatcacaattactttttaaatgcaaactagctgtgaaagttgtctgtctcaaatatttaagactataattttatgatcatacaactcatactcccagcactcagtaaagacaacgtatatttctgtcagtctttcatatgcacaattagaaaatgattaaaatagtctgataatagatttccctgttaagctcagaagcccagtattctttcttggtttttaactggcatgctccttttaattttatatgtatttcttttaatgatgaatatagaggcaataaataatacttttctttatatatgattggattacaattaactgatgaatttaggaaaggacttaaagatttatttttatcatcttgtaatttaaaacaaaacaacagggctataaactccaaatatgcaagtaaatgtaaagctcaacttcaaaaaataaatgacttgacaatgatgaaaaagtagaaaatgtttgagaaactttatagaaatatccttttacttcaaaaacaggagaaatatgtactgcaggtaggcccctacttacagactcctaattattcatatgtgaattctcagagggcaagggctgggggtaatactgcttttaatgaaagtctgctcttatgagttttcagatgccataaccaaactgacattgtgtaccgttgttctctggggagcttcatgcacagaatgaactcatatgttacatgaccttgggccaaacaatatcttaaagaagtaatcagtataacatttcagaaattgaggtggccaaagtcggtccaggaaagtctctcaggatttgatatgctgagtgcaggagaattcattttccattcagagaaaaggtcgtacaaagtcttcatgtgcctcaagtgctgaaagcaatatagaagaagaaaaattgggcttaaacaaaattttaaaaaatctgtcttcattttctcccccgtgatcctttatatctaggaaggctattactgtggagaggccttaatatggactatttagaccagtcatttgaacaaatgtcctaacaacagcagaaaaacatgatcagtgttctgcagaatctggacttgtaatcaagtagtcagtgtttaagagacaagtttaggtcatggaaatatactggagccaaaaatcagaattctagtttttgctccagcactgatttgttcagctatgagtgatgttttcagatagatttctttagggtaggaagcaataatgttatatgagttggaaaggcttgatgaatgttactgagtaaatagatgtttgctgattgctgttgaacagtggatcaaattattaaagaaaagttaggatagaaaaatccaaatacaggcggggtgcggtggctcacgcctataatcccagcactttgggaggccgaggcgggcggatcacgaggtcaggagatcgagaccatcctggctaacacggtgaaaccccgtctctactaaaaatataaaaaattagctgggtgtggtggcaggcgcctgtagtcccagctactcgggagcctgaggcaggagaatggcgtgaacccgggaggcggagcgtgcagtgagccgagatcgcaccactgcactccagcctgggagacagagcaaggctcggtttccaaaaaaaaaaaaaaaaaaaaaaaagaaagaaaagaaaaatctaaatacaaaattataacagtatgtagccatttagagttcattagttacaaagctgttaagattatagatattgcgtattataatatatatgtgtggaatttctggaactgatattgtttttgtttaagcagttgccagtttggcaacattttacattttctgtagtgagtgaaaacaaattatttgatctgtaattactattttatgaaacatattatttgactgttaaatcatcaattcttttggagctggccaacaatgtaccaatttatttttagtagtgcagcccatgataaagaaaagcagaaagccactaaggacaaaaagattactgagagctcctcctcattgtacttaaattttgtttaggatgagataaacggaaaaagagcttcagactttgaagatctagaaatgtgggcaaattttccaaatgttcgtgtggatgagtaaactgtcacatttccagaacgaagaacattgttttttattctgcctggactagtattagggaaaatgttcaattgaaaaagttaccatataagaattatatccagagtatcatatttaattgattttttgcttacacacacacaaaaaattcaattatcaatatttttgagcaaaaataaggcaacaggtcaggctctaaaaataaatataagactataaaagatgcatgtcttatattctaccatggtaaatggggcagtgaaaggagtatgcggagtcctccttctggtatacagaatttatattattgctttattattgcctcacacacatcaacccttgaggcaggaaagatgtgttcatagaaagcaacttaccagtgaccgtgccagacatgttcaaatatgcttcactatgatatggtaagaatacactaatattaatgtaacatcaacaagaattcagtaaagatagaaatctgataatagtaacaaccatcattaattaatgagtccttgttatataccaggcactgtgttagtgctctctgtctttctgtctgtctctctctctcagaaactatgcatattcatatatatttatataaaatgatcatacaattctagcagccacataaaagtttggaagcgtttccccttttttctctttttgaagaaatggggaaacacaggcacagacaaatatggaaactttgcagcattcatgcagaggatgcagaatggagcctgaattaaaatgctccctcggatagaagaggcttcattcttctttctagaaagactgtgtggtgaaggtcctggattgtgacaaatatgctatttcctctaaacccagactccctcctcttcaggtggtttgaaccgtctttcctacccctaaacctgtagattatgcctccatctctcccatccttacactccactcaaaaggtaatctgctctcttcgttctttctcttagtccattctgcctccaaatgtctccaccatactctctctggaacaccattccattctcatcaactccctccacatcctctaccttacacaccttgacttaagtgagccttctataaagacactgcccacctcccacctccagcaattcaaagggatgcttctcagagttggaggcttcttgggggtgggaggagaggccagtgttctccatcctcagtgcagttccagaccattcctcctctgaaacaaaccctttcccttgaggctgacaacatccagccatgtgaccctgtacttctttctcacactcttttgcttttactgaagactttgaagctttttctctaagtttcaccatcatttttgtatctggcacatagtagttgctaaattatattattaaaaaattcacagtgattattcgtaataaattatgtgtgatacactcacaattcatggtgaaatgaccatgtatctcgagaagagatttgaaaaggacaatgaggacaccccttcccatactccaaactctaagttgcatgatcttgtcagtctccggattgtcagccatccacttccacagccaaatcctagacatgctggagctttgaaatattcgattataatatcacatacatacacacttattccaaactgcattcctccagccatcactcatcacctccactctgcctttcttcattgtattgtaaagaatgaattgggttagtgtgacagtctttatcagtattcccattactctactattttgtcttcctaccgtacctcctgtggaaaaaaattccacatcatcatccaccagaccgtcttctgttctcctcctacacaaacaactctcctacagatggagaaactcatataactgcattaaaagttcatttgaaaggcatagttgccaaactcaattggaataccacctggtatttctatattttcctgggcaactttctctttcacttcccacagagcatatttcaaacttctattgtgctttagttttctttattacatcaccatatgaaagtgtaattcatttattctgcacttacttactagacatctgttatgtgccaggcaaagggtgctgggtattatggtagaaaaaagtataacatttgagtttgttccctctcacttctgccttcgttcctaaaagcattcacctatctctgtgccaaccttgcctaggggaagatatatctccctccatgcccaaccattctacctgtactctgttagctcagccattacctcagttagcttatccctctctcctctacctgaaaattctccatcctaccggctcacttccccagcagcacttacacttatttatttctgtcctatctttaaccaatcaatatgaccactctcaaccatcatgtttgcttctaagtatttccctatatcttctactttcttcagacccgcggtacagttgtccatgctcccctcctcattcatttcattctctctccagcctcctgcagtttggcatcttctccactattctactgcagcggtcccttccagggtcaacaaagcctctttattagaaaatgcacagggcacttactttcttcagtctttgaactctgcaggcattgtgtgtgtgtgtgtgtgtgggtggagacagaatttcgctcttgctgcccaaggctggagtgccatggcacaatctctgctcactgcaacctccacctcctgggttcaagtgattctcctgcctcaccctcccaagtagctgggattacacgtgcctgccacaatgcctggctaatttttgcattattagcaaagacagggtttcaccatgttggccaggctggtctcgaacccctgacttcagatgatctacccgcctcagccttccaacgtgctgggattacaggcgtgagccactgtgcctggccaggcatttctttttataaaccctgtaccctgcctctgggccaccagaggttcctggtcttctcccactcacctctatgttcagttactctgcctgtcatgacatgcggtgatcctctatgttcattcttctctccttacagtttgtgtgttccatgaatgacatcatttactccctcaaatccaagtgcatattttatttgtgtgaatccccaataagtaagttcctatggacagaggctgtgcatgttcgttgttttagtcctgacacctatcacagctgcctgacaacccagtgcccagcaatacagaaaaatgcacagactgaataatacaggaaattgtaggctgggcgcggtggctcaggcctgtaatcccagccctttgggaggccgaggtgggtggatcacgaggtcaggagatcgagaccacgatgaaaccacgtctctactaaaaatacaaaaaaaattagccgggcgcggtggcgggcgcctatagtctcagctactcgggagcctgaggcaggagaatggcatgaacccaggaggcggagcttgcagtgagccgagatcgcgccactgcactccagcctgggcgacagagcgagactgtgtctcaaaaaaaaaaaatacaggaagttgtaaccaggaggacccattgaaagtggagtgtattctttcactcagtattcactgggaatgcactatacactagttccaatgcttgtgttgggaattcagtgaagagcaagaaagacaaagtagcccctggcacttacattctagtaagggaaatagtcattaaacatatatactatataggatgtcagagagtgacaagtgccacgaagaaaataaagcagggaagggagttacagagtgatagaaggtaaaagtgtgccagctagttagggtagtctgggaaggaaggctttctggtggcattaaccctgaagaaatgaatgtaatgagaaaatgcctagcggctatttgaaagaaaaccatttcaagaggaggaaatggtaagtacagtgaagtgggaaaggctttggggtacttgaggagcagaaatcaggccaaagggattggagctgaagttctgattctaggtagaatataggaggcagtggcactgcatcactcccactggaacaagtagttcaaaaagtaaagaaattggaaatgtaatcgttttaaagatatcagagagctgtggtggcatagatgattagatggactacaagtgaagttgagatgactcctatttccttcactgagaggcaaggtttctgttcagacttgccccaagctgaggtgtttcgccaggggaaagagaagacaatagagtttactttctacctagcttaattgaggtacgactcatgcaccgtacaattcacccatataaaatttacaattcaatattttttagtgttttagagatatgtgcaaccatccccacagtcaacttttgaacatttttatcacctcagaaataaaagccatggccgggcacagtggctcacgcctgtaatcccagcactttgggaggccgaggcgggcagatcacgaggtcaggagtttgagatcagcctggccaatatggtgaaaccccgtctctactgaaaatacaaaaattatccaggcactgtggcacgcgcctgtagtcccagctacttgggaggctgaggtaggagaattgcttgaaccctgcattccagcctgggtgacagggcaagactccatcttaagaaaaaaaaagaaagaaaaaaaagccacatgcttcagctattactccttgtcttcctaagcagcagctaggcttctttctcccagtagattgtcctattgtggacatttcttatgaatggagtcaataatatgtggtcttttgttactgacttctttcagttaacataatgttttcagggttctccatgttgtggcatgtatcagctcctcattccttttctgtgagtaaagaaaaaataacaaaatttaacattttaaccattttcaagtgtacattacagtactgttaactgtatgcaagttgttgtgcaataggcctctgtaactttttcatcttgccaaagggaaattctgtacccgtggaaaaactccccatttccccctcttccctagctctggttgtcacattctactttctgtttctatgaatttgattactttcgaaaacgtatacacagggaatcatgcagcattattcctttcatgactggcatatttcatgtagcataatgtgctcaagccttatccgtgttgtagcatatggtaagattttcttctttctttaggctgaataatattccagtgaatatatggtttatacattaatttgtcaggagatattagtgttcttccaactcttggctattgtgagtaatactgcaataaagatggatgtgcaaatatcttttcaaaatcctactttaaattttcttgatatatacccagaagtgggattgctggactatatggtagtcctgttttaaattttttgaagaacctctgttttccatagtggctacaccattttacgttgccaccaacagtgcacaagggtttcaagttctctatatccttgccagtatttcttattttctgtttctgttttgtttttttggatagtggtctagctaagagatgtgaggtgacatctcattgtggttttgatttgcatttctctgattagtgatattgaacatatttttaaatgttggccatattgatgtcatccttaaagaaatgtctattcaaatactttgttaatagggttttttgtttgtttgtttgtctagttttgatgttgttgagttgtaggaattctctatatgtttggatattaaccctcatcagatacatggtttgcaaatattttcttccattctgtaggttgccttttcactctcttcattatttcctttctatgcagaagatctgaagtttgatttagttgcatttgtatatttttgcttttatttcctctgcctttggtgtcatgtccaagaaatcattgccaaatccaaaaacatgaagcttctcccctatatttttatcttactagataatgttataattttataaattttagttttataaatataattttataaattacagttttataattttaggtcttacatttaggtcattaatccattttggtttgtttgttgttttgagacagggtctctctctgacaaccaggctggagtgcagtggcatcatcacagctgactgcagcctcaaccttctgggctcaagcaatcctcctgccttacccccacctctcccagtaggtggcactacagggtgcgcgccaccacacccgggggaatttttacattttttgtagagacgggttcgcagtgttgcccaggacttgagcgatcctcccacctcagcctcccaaagtggtgggattacaggcgtgagccactgcacctagccgttaattcattctgaagtgatttttgtatataggtacaggaaggtaagggtctaacttcattattttacatgtgaatatcaagttttctaagcaccatttgttgaagacactatcttttccccattgtatagtcttgatgcccttatggcagattattttaccatatatgtgagagtttatttctgggctctctattctggcccattggtctatatgtgtgtctttattccagtattatgctattttgattactgtagctttacactgttttttgaacttgagaagtatgagacctccagctttgtatttctttctcataactgtcttgactatttggaatactttgagattcctaatggattttggattttttttctgtttctgcaaaaatttccaatgagatttttatacggactgcattgaatctgtagatttggggggtagtatgaacactgtaaccatattcttttccaatccaggaacatgggatgtctttatatttattcgtgtcttcattaattactttcagcaatattaagagtattcagtatacaggtcttttgcctctttggttgagtttattcctaagtattttattctttttgatgctcttgtaaaggggatttaaaaacattttcttttctgattatttattcttagtgtctagaaatgaacctgatttttgtgggttgattttgtttcctgcaactttactgaattagtttattagttgtaacagttgtctctctgtgtgtgtgtgtgtgtgtgtgtgtgtgtgtgtgtgtgtaatccttcaggttttctacatgtaagattatatcatctgcaaacagagataattttatttcttcctttcaaaattgaatgctttttactcctttttcttgtctaattgctctggctagaactttcagtactgtgttgaatagacatggcaagactgggcatgcttgccttgtttctatttgtagagggaaagcttgagtatgatggtagctatgggcattacctatagggcttttaatatgttgatgtaattttcttttatttctatattattgaattttacatgaaagggtgctgaattttattaaaagcttattattgcactaattgagatgatcatgtgacttttttacctttctgtcagttaatatagtgtattgcattgactaatttttgtatgttgaaccatccttgcatcccaggaataaataccacttggtcatagtgtactgctgaattaagtttatgatattttgttgagaatttttgcatcaacattaagcaagattattggtgtgcagtctttttgtggtgtccttctttagcattggtattaaggtaatactggcctcataaaatgagtttgaaagtattttttcttctgaaatttttcagaggagtttgagaaagagtgatgctaactactctttaaatgtttggtaaaactcatcagtgaaaccgtctagtcctggggcttttcttcattgggagatttttgattactaattcaatctcctaagttatagatgtgttcagattttaatttattcacaattcaatcttggtaggtagtatatttctaagaatttatttcttctaagttatccaatgtactggagtattgttcatagtagtctctcgtaatctttttacttctgcgtcctcatttttaatgtctcatttctgatttgtgttactttagacttctattttcttacttattgaaagaatttgttaatttttttatttttttaaaaaactcttatttcattgatttttctatttttttaatttattctctatttcatttatgttttctgtaatctatgaccttccttttgctaactgtaatctaggaccttccttttactaactttggatttagtttgctattctttttctagttctttgagatacaaaattatctccaattattgattggggatcttcttttaaaaatacaaacatttactgccacagttttggtgtgttgtgttttcattttcacctgctttaaaatactgttaaatagtgatttcttgactcatcaagttgttcaagagtatattgcttaatttccacatctttgtgaattttctagttcagagttttctagtccagatttctagtttcatgattattagaaaatatagttggttttctttcagtttttttttgaattgttaaaacttgttttgtgtcctaatatgtgttctgtcttggagactgttttatgtgcacctgagaagaatgtgtatattaacatagggtggaatattgtttatatatctattagagtcaattcacttttagtattgttcaagttctttatttccttattatttttctttctggttgatctatttattattgaaaaagagtattgtaatctcctcctattattttttttaatctaattcttcctccagttctatcaatgtttgcttcatgtatttgggtgctctgctgtttggtgcatatagacttataagtgttgtactgtgaattgacactttcatcaatatgatgtgtcttgtttttctcttgtgacagtttttagcttaatgtctattttgtctgatatatgtatgggcacccttgctattttggttacctcttgcatggaatatatttttctattccttcattttcagcctgtgtgtgttttcaaagctaagtgaatctcttgtagatagcatgcaattggatctttttaaaattgattctgccactcggtcttttgactgcggagtttaatccattcacacttaaagtaattattgatggggaaggacttactattgcaattttgttaattgttttcagtatgtcttagagttgtttgtccctcttttcctctcttgctgcctttgtgtttcattgatttttttgtagtgttatgctttgaggacttccttattttctttggtatgtcttctatagcaattttctctgtaagttaccatggggattatataaaacatcttatagctataacaatttatttaaactaaaaatttaattcaattgcatacaaaacctctactcttttacctccaattcaccttacattatcaatgtcacaaattatacttttagtattttgtatccattaatataatttaataattatggttatttttatgcttttatttatacctgatttaaaaatgatttatggaccactattgtagtatgacaagattctgcattttttttttttttttagacagagtctcactctgtcacccaggctggagtgcagtggtgcaatttcagctcgctgccagttttgcctcctgggttcatgccattctcctgcctcagcctcctgagtagctgggactacaggcacccgccaccatgccctgctacttttattttattttattttttatatttttagtagagacagggtttcaccgtgttggccaggatggtcccgacctcctgacctcgtgatccgcccacctcagcctcccaaagttctgagattacatgcttgagccactgcgcatggcctagattctgcatttgactatatgtttacctttaccagagagccttatacttttgtatgctttcaagttggtatctagctttcttttatttcaactgaaaggactaccgttagaaattctagcaaggtaggttaatggtgatgaacttcttcagcttttgtttatctgggaagatctttatttctccttcatttttgaagggcagatttgctgtctattcttagttggcagttttctttctctttcagccctttgaatatactaccccattccctttcagtctggaatgttcctgctgatgagtttgctgataatcttatgagagttctcttgtatataagtcacctttctcttgctgctttcaagattgtctgtcttggacttttgactgattataatgtgtcatggtgttggatctttaggttcatcttagacagagtccttcaagctgctgaaatttggttgtccatttcgtttttcagatttgggaagttttcagccatttcttcaaataagctctctgccacaggctactcttcgttgtgcaatctgtggacccagttgtcatctgccaccactgtctagttatcttttgactgccacaagtggactccaaaaaatctccaaaagaaattgttaccataacaagatggccaactagacacagccaggaagcactgctcccactgagagacaccaaaatattgagtacaccaacgtattttgagcccatcttcagagagaaaatgctgagagtcattacagaggtgatgcagacaacaaggctgaagagggaggaagctggaaaccctgcacaggatacttgcatgacagggctagttcccagacctggatgcctcctggggaagggataagtgaagggatggagggacaggccactctcactgtggacctctgggatcctaggtacatagaacttcacattctccatggacatttgagctggcagggggatcttcaaagagagttggcagagacagggcttcaccggcatggagcctaggagcttttgtgcatgtggagctgtggcagagcatggcctagacacccatcccccagggctccccacctccctacaggcagctctagcctcagctgattgctggcccaggagagagtgtggctggcttccctgtgggactgggaaacttccagggcccctgcctggccaccctgcaggaggtgtgcacagagtagcctctgctgccaagcctgggtgctttgcttcacctgagtaccttcctggtggcctgggagcactttggatcccccagaacagctggggcccaatctcaagggtctggaggatgaagctgaaagccagtcctagctccccaaaactacacaaatacatggaaattgaacagcttgctccagaataactcctcggtgaacaataaaattaaggaagaaataaaaaaattctttgaaataaatgaaaatagggacacagcttaccaaaatctctggaacacagctagaacagtattaagaggaaagtttatagcactaagcaccttcagcaagaaattagaaaggtctcaaattaacaatgtacctttgcaactagaggaactagaaaaaaacaagccaaccccaaagcaagcagaagataataaatatctaaaattagagaagaactgaatgaaatttagacacaaaaatccatagaaaagatcaatgaaacaaagtgttttttcttcaaaagaataaacaagatcaataaaccactagctatattaacaaagaaaaaaagagaagatctaaataagtacaatcagaaatgacaaagaagacattgcaactgatcccacaaaaatacaaaagatcctcagagactattatgaacagctctatgtacacaaattaagaaaacctagagaaaatggataaattcccggaaacacacaaattcccaatattgaaccagaaagaaaatgaaaacttgaacagaccaataagttccaaaattatatcagcattaaagaaactgccaaccccaaaagaaaaaaaagaaaaagaaaaagaaaagccctggaccagatggattcacagacaaattctctcagacataaaaagaagaactggtaccaatcatattgaaactattcaaaaaaatcgaaaaggaagggcacctctctaacttatcctatgaaaccagaatcagtctgataccaaaatctggcagagacacaacaaaaaaagaaaacttcaggccaatatacctaacgaacataggtgcgaaaattctcaacaaaatactagcaaactgaatcccgcagcacatcaaaaagttaatttaccacaataaggcaggctttactcctgggattcaaggctgattgaacatatgcaaatcaataaatgtgatccaccacagtaacagaattaaaagcaaaacccatatgatcatctcagtagatgcaaaaaaagctttcaataaaatccaacatcccttcatgataaaagccctcaacaaactaggcatctaaggtacatacctcaaaataataagagccatctacaccaaacccacagccaacagcatactgactgggcaaaagccagaagcattccccctaagaacaaaaacaagacaatgatgcctactctcactgctgctattcaatgtagtactaacagtcctagccagagcaattaggcaagaggaagaaataaaagacatccgcggctgggtgtggtggctcacgcctgtaatcccagcactttgggagaccgaggcgggcagatcacgaggtcaggagatcgagaccatcctggctaacacagtgaaaccctgtctctactaaaaatacaaaaacaaaaacaaacaaacaaacaaacaaagacatccgcatgggaaaagaagaggtcaaattatctctcttcactgacagtgtgattctctctttttttgaaactgagtctccctctgttgcccaggctggagtgcagtagcaccatctcagctcactgcagcctctgcctcctgggttcaagtgattcacctgcctcagcctccagagtagctaggattacaggtattcaccaccacgcccggctaatttttgtattttttagtagagatggggtttcaccctgttggccaggctggtcttgaactcctgacctcaagtgatctgcctgcctcagcctcccaaagtgctgagattacaggtgtaagccaccatgcttggccactgataatatgattctatatctagaaaaccctaaagactctgccaaaaggcccgtcaaactgctaaatgacttcagtaatgtttcagggtacaaaaataatgtacaaaaatcaatagcatttctatatataactgagtacctcagcctcgaaatacatttttaaactatttttttcctttccttcctaatctcagaatgtagccttatagtgtaagactctttgttatgccctttccctacaggcatatctgtgtacagtgcttgctcatctaactatgtgcttgcttagaaattccaggagccaattttgaaacaaaccaggcagagagaccaagccacagatcttcccactcaaggggagttacgcccaagtcaggatgatgcaaatcagatctctagatgggagattacttgagataactatgggaacaagacatgcagatatgcactcccttttcactactcatgtctatatcccacacctttttccttcttaaaccccttcactcagcccagaaggctgagatggctcttttgaggcttatgcccagacattgtcccatctgctagcatttgaccaataaaagttgctttcctttcaccacacctcagttctcatgctttgacttctgagaggagagcagctggacttgagctggttacatatacaccaataatgttcaagctgagaaccaaatcaagaacacaatcccatttacaatagccacacacaaaaatgaaatacctaggaatacagctaaccaagaaggttaaagatctctacaaacctgacaatgttggtgttgtcgtgtttggaaatgattaactgattaaggaaggagctagaatgaagaggacaagagccattgtggacattccagttggtgaggagctgttgggtcatgtggttgatgcccttggtaatgccattgatggaaagggtccatttggttccaagaaccataggtgagttagtctgaaagcccctggaatcattcctcaaatttcagtgcaggaaccaatgcagactggcattaaggctgtaaatagcttggtgccaattggccatggtcagtgtgagctgattattggtaatggacagactgggaaaatctcaattgctattgacacaatcattaaccagaaatgtttcaatgatggatctgatgaaaagaagaagctgtactgtgtctatgttgttattggtcaaaagagatccactgttgcccagttggtgaagagacttacgatgcagatgccatgaattacaccatcgtggtgtcagctacggcctcagatgctgccccacttcagtaactggctccttacactggctgttccatgggagagtattttagagacaatggcaaacatgttttgaccatctatgacaacttatccaaacaggctgttgcttaccaatcagatgtttctgttgctctgccaaccccctggttgtgaggcctatcctggtgttgtgttctacctatgctcccagttgctggagagagcagcccagatgaacaatgcttttggtggtggctccttgactgctttgccagtcatagaaacagactggtgatgtgtctgcttacattccaatgaatgtcatttctatcactaagggacagatcttcttggaaacagaattgttctacaaaggtatccaccctgccattaatgtcggtctgtctgtgtctcgtgtcagatctgctgcccaaaccagggctatgaagcaggtggcaggtaccatgaagctggaagtggctcagtatcatgaggtcaccacttttgcccagttcagttctgacctcgatgctgccactcaacaacttttgagttgtggtgtgtgtctaactgagttgctgaagcaaagacagtatactcccatggctattgaagaacaagtggctgttatccatgtgggtattaggggctatcttgataaacgggagcccagcaagattacaaagtttgagaatgctttcttgtctcatgtcagctggcaccaagccctgttgggcactaccagggctgatggaaagatctcagaagaatcagatgctgaatttgaaccttaaacgcctgtggatttacatcaaataccagttcagttttgtcattgtttattctagtagattagtttcatttgtgaaagggttactctcatactccttatgtacagaaatcacatgaaaagtaaaggttccataatgtgaaaaagaaaaaaagatatctacaaggagaactgccaaccactgctggaagaaatcacagatgacacaaataaataaaaaaaaattccatgctgatggattggaagaatcaatattgttaaaatgaccatgctgcccaaagcagtttaaagatttaatgctataactaccaatgtcatttttcacagaactagaaaaaactattctaaaattcatatagaaccaaaaaacagcccgaatagctaaagcaatcctaagcaaaaagaacaaagctggaggcatcacactacccaacttcaaactatactataaggctacagtaagcaaaacagcttggtcctggtacaaaaaaagacagatgaatggaacagaatagataatccagaagcagttctgcacacctatagccatctgctctttgacaaagcccacaaaaaaatgggaaaagggtcccctattcaataaatagtgctgaaataactagctagccatatgcagaacaatgaaactggacccctaccttttatcgtacacaaaaattaactcaaaatgaattcaagatttaaatgtatgacctcaaactatcagaatcctggaagaaaacctaggaaaaacagtattctggacatcagccttggcaaagaatttttggctaagtccccaaaagcaattgcaacaaaaccaaaaactgacatgtgggacccaattagactaaaaagctcctgctcatcgaaagaaactgtcagtaaacagacaacctacataataagagaaaatatttgcaaagtatgcatctaacaaaggtctaatatccagaacctatgaggagctcaaacaaatccagaaaaaacaaacaaataaccccattaaaaaatgggcaaaggacatggacagatacttctcaaaagaaggcatacaagcggccaacaaacatatgaaaaaatgtccaacatcactatcatcagagcaatgcaaatcaaaaccacaataagataccatctcaccccagtcagaatggctattatgaaaaggtcaaaaaacaacagatgctggtgaggctgtgtgtgcataaaagggaatgcttataaactgttgaggggaatgtaaactggttcagccactgtggaaagcaattgaagatttctcaaagaacttagaactaccatttaacctaccaatcccattattgggcatatacccaagggaaaataaatcattctaccaaaaagacacatacacttgtatgttcataacagcattattcgcaatagcaaagacatggaattaacctgggtgcttatcaacggtagattgaattttaaaaatgtagtagtagtacatatacaccacagaatactacacagctatagaaaataatgaaatcatgtccttttcagaaacatggatgcaactggaggccataaccctaagtaaattgttataatataggaatggaaaaccaaatacagcttgttctcacttgtaagtgggagccaaacactgagtacacattgacataaatatggtaacactaggcactgtgaactactggaaggggcaggagggaggagagatgggttgaaaaactgcctgttaggtaatatgctcactacctgggtgatggaatccatatcctaaacatcagcattattccacatacctgtgtaaaaacttgcagctatgtcccctgaatataaaataaaatcaaaattatttttttaaaaagaaattgttgtcattacaggaagtggtagatattttgggttctgcctaggctgtttctgaatcagaagggagtccatatgattctgtttgacataagtatccctgctcaaacctttctggaaggaatcaactttatacatggagacatctgtcatctctctgaggtagagaaagccttccaggatataaatgttacctgtgtgttccatattgtcttttatgttatgtcagggtggaaacaattgaatcaaaaactgctggaaaaagtcaatgtgggggacacaggcaatgtcctccaggcttgcaggaggataggagtaataaaattagtttacactagtgcttttaatgcatatttggaggtgaaatggtcagaaatgaagatgaatctgtctttcttagctcttcacctctaaagcaatcactactctcagacaaaattgactatggacaaaaagatagtggaagtaaatggtgtttttcctcccctacatccctaacatcctgaatcccttcccttaagtctgtgaccactgggatacttggtcccactaagatagctttcctccactatgattcctcatctacatgttcagtgtcatcagaagaatgatgtccttttccagatagctgaattacacagcatttaaatttatcttatttcattttttatgagaagttataatattggaataaaaagcagaaacaaggaaagagattttctgaagtatacattttatatgagccaaggaattagtacctggaaaaataaactgtgatgtttaaaattagtttatatatggagataattatgtttcttgctaaaatgcctatcaccctactgattctcaatttgaaataagcattataacttttacatgtatgaatatgaaattttacaaatttgacaggagaggccagagaattagcttgctctttttccaccatgtaggaataaaataagaaatcagcagtctccaatcagcagttactggaactcaaccatgctgatgccttgatcttggacttcccagccaccagaactatgagaaataaatatttcttgtttaagccacgcagtttatgataatttgttatatcagcctaaactgattaagacaaaaatgctaagaaacagaaggaccacatagtaaaattccataaactgttctggaattttatatctactactaaggtctagaatccagtaggtcctcatggattgaatatggcaccagcaagggggatgtggacatgagccagatcctaacacaaaggatatttgccctcagacctcctttatggttccttccaggagtgtgcagcccagaataaaggtttgatggagtgactggtgccacaggtatgagcaatcggctcataatgggggcaacagtttggaatcagagaatcatgattattcttgtaaatgatacttatggaccaaagaggcacattgggctcagaacatagcattttttcccctaggtctgtcagcctatatatcttttacaggccaggtatgtcaagagtctacatttgggagaggtcataaaatccatataatatacattttgtacacaatttcagaatttgtaacagattatactcaagatactgcattttatctagtgtgtttttacattataatttcacagggtaacagcttctcattttcaatgctaggttacttttatgtgatattcacattttgtaccaatctggtgttcagattttatattgcttgatatgattttttaagtgcataatcactttcttaaagtttctgtttaaaaacttatgggaagcatgacataatataaattatattagagatggaatacttaatatcccctaaaataccagataacttagaccagtatcccagtatttaaatatatagttgataactcaaagtaatttatcactgtttctctgtaatcattttgatgtcacaggttgtttaaggcttaatgatgattaagaacatttagtgaatttatgaacactttaatgaattgatttaacatttcagctgtttatgtgcaaggacccataaaattatcaatttaaatgacttgagaattaaaatataatagtttattcttggagcatcactttttctctctccagttattggtcaggctatcaaatgcttttttaaaaatctaagttttaaatatttttatttatttatttattttgagatggagtttcactcttgtcgcccaggctggagtgcaaaggcatggtctcagctcactgcaacctgcacctcccgggttcaaatgattctcctgtgtcagcctcctgagtagctgggattacaggtacccgccaccatgacccactaattattgtatttttagtaggggaagggtttcaccatgttggccaggccggtctcaaactcctgacctcaggtgatccgccccgattggcctcccaaagtgctgagattacaggcttgaaccaccatgctggcctagatatttttacatgagattgtggatgataatctcattttgggtagatttgtattctgggtagatttttatcagggatcctgatttaaaaagaaaaaaaataaattttttttctggttatgattagcatttttcattaattaccacctattttagttaaggtagctctatttaattcatacaacattttatttgttagtgcatggtgcaattaaaacaatagttacaatgtcatgaaggacctgcgccaagaatcacatgacaccacatagccatcagtacctatgacaatgctacttttaaattctcattttttaatgagaatattgagggtccaagatgttaagtaactttcccaagaatacacagctagtagattcagatttataaggccacaaagcctgggttctcagttactactctgctcactggaacttgtgggagcaaattctgatcaacttataagctcttcttccccaaaagatcttatcttggagaagaaggagacctctatactgcagagctaaagttttgagtaggtcgtgcttgacttctggggcatgaaaactggttttatgaaggtaaaatcatcagcatttccatggagcatcttgtgtttctcagggcatgggaaccaaccatctgcagtataaagtaaatttttaactcataagtcaatggaattgttgttggtatggatatcaccatattatttggcaggtgattctttttttttttttttttttttttttttttgagacggagtctcactctttcgcccaagctggactgcagtggcgctatcccggctcactgcaagctctgcctcttgggttcatgccattctcctgcctcagcctcccgagtagctgggactacaggcgcccaccaccacgcccggctaattttttgtatttttagtagagacggggtttcaccgtgttagccaggatggtctggatctcctgacctcgtgatccgccctcctcggcctcccaaagtgctgggattacaggcgtgagccaccgtgcccggcctaggtgattcttattgaaatatcataaagggcaagtattgtgacaacttttctccatgattaataaaacaaacagataatctttataatactaatcattgctgtttctttataaaatgttcttgattacttaaagtactattaaattaaaaatcagatttttgcaacatgtagaaggctcttttaaaaaaactataatattattctatattgtatttctgtaggtataatatcacatcaccataatctgcatggtctaataaaataatagactgtttctcaataaatagctttcccacaatatggaaacattggcaatgttttgtttttttttttgtttgttttgttttgagatggagtctcgctctgtcacccagactggagtgcagtggcatgatctcggctcactactacttccgccttctgggttcaagcgattctcctgcctcagcctcctgattagctgggactacaggcatgtgccactacaccaggctaatttttttgtatttttagtagagatgaggtttcaccgtgttagccagggtgatctggaactcctgaccttgtgatccgcctgcctcagcctcccaaagtgctgggattacacgcatgagccaccacatccagccggcaatgttttttaacatgtagtttagtcttcagaccctctcaaattacttactgaactaaagtatgccttttataagaaacaacattcagtaatataaaaataaactctcatctcttctttactttccatttaatttaaggtacattttggaggacattcttgtgcttacttcatgtaacctcacttgcttttaggtgaattcaaaattctaatgttaatcccttgtattagggttctctagaggaacagaagtaataggatatatgtatatacgaaagggaatttattaaggaatattgactcggatgatcacaaggtaaaattccaggataggctgtctgcaagttgaggagcaagcaagccagtggtggttccgtctgagtccccaaacctcaaaagtagggaagctgacagcgcagccttcagtctgtggccaaaggctcaagagcccctggaaaaccactggtgtaagtccaagagtccaaaagctgaagaacttggagtctgatgttcgagggcaggaagcatccagcacaggagaaagatgaaggctggaagactcagtagtctgctcttccatcttctcctgcctcctcgctggcagctgattagatggtgcccaccagattgagggtggatctgcctctcccagaccactgactcaaatgttaatttcctttggcaacaccctcacagacacacccaggaacaatactttgcatccttcaatctaatcaagttgacactcaatattaaccatcttcttactgagcagttaactcataataacactgccaaagagaactctaacagttaacagaagcgtcgtttgttgtcctaagtctgtcataatattctgtataacctttgaagaaacatttaaattttcctctttcaagcaatgaaatatgcattccttaaattgaaagaacatgagcttccttgatgcgttgcctgacatggtgggaaaggtgagcccctgagtcggaggactcatcccggatcccattctctcacaggcttgtgaaagcagaagtcaccttccttctgaccttggcatgtatcctgcttcaagaatggaactggaggcatatctattcttattacaaagaaaatttaagtcattctcctatagaattttaatttcaatcattgttttaggaatttgcaaatatatggcttgctttgtcttaactaatagaaaaagtgtcctttttcaaaaagagaagtgttaatgtaatgataatagtaatgacttcacagaatgtgtgttctgttccaagcactttaagcatattaacaatttaatcctcacagtaatccttggaggatgatatcatcctgattttgcaagtgagacaactgaggcacagaaaggccaagccttatatagcagagctgggatttgaacccaggatgtctggctcttaatgctgttagtttacattcttaactgtgggccagatgtgtgtaactgactatcaaacgtggttctgacacaaaattctacatctaaattccaatctccattttacatttctgctaacctgacgggggaaaaacttttattttaatatgaccagggatccacattttgaaaaatattgccagtgcagtcctgacagccacttcttcattcttaagcacctgggaggaaactgttcagaagtggttggttatgaaatggtaaaatcagctctgccctgctgatgaatccagaataattaccaatgactaagtccagcctcatgaccacttcttgagtgacattgagtttgcatcctaatttgaagtttacaattctggcaagatattggacagctgcagggataattttgttcacaaatatagatgcaaaattctatgctgcgttaaagctattttaaagagcatattttaggactagtgtttatttccttgtgtctaaatttcctgttttgcatttgcttcagctaagattgttttgggctaaacttatcttcctacacagacccttgatagcatgtaaatcaaaataatcataggcatatttaattatatgacatttgttgtctctacactaaagtttttctaacattcttaaattttgtctacataatgaatatatttttaacagaaaaaaaaactataggtttgattgcctgcttatttaaataaaaagagaaagaagagatagaagaactatgaactctttattggttgccaaacaataaaaatacctttttggggccgggcgcggtggctcacgcctgtaatcccagcactttgggaggcgaggcgggtggatcatgaggtcaggagatcgagaccatcctggctaacaaggtgaaaccccgtctctactaaaaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtcttaaaaaaaaaaaaaaaaaaaaaaaaaatacctttttgggaaaaaagtaaaccccattgtttccttgaatgtgcttgttctttcagctcagtcctaagagtggatgattactgagcacagggccctgagatgaactgagggactcgcatctcattcaagcctcacaaagcagtggaaggattaacgttttcttcattttataaagagcacactgagactaagaatggttgattagtttgcccaagttctcaagagtagtaaaattttgagccgttaatttaaaacagaccatctggaggtagactagagctgagaatgatctcaattaaaggaaggaattctgtcactttgtgaagttttatgaagagataagatagaaaccaacctactgagtattaaacaaaaggctatttcccgaaaacatccttccacattcattcttcaatcagtaaaattttactaccattaaggcagaaaaagggttagacacaattccttccttcaagaagtttagaggttaatagggacactacaatattcgtgacataacttaaaagctacataaaaacagtatagaaaggtaaagatttctctgtgaaagaggtataaaaaagaaaatattttcctcatggtaagcttgaagtttcttcctccctgggaggcttaaaggagtcttcgtgatggagatctagaatccatctttagttggttagtgtgtgcacatatgagagggaaggccatgctgggcctgatccaagaatgaggctggaaatgggtgtacttttaagaaaatgaataaataaataaatgatcttgtttgcctaggagcctgcaagggactaatggaagctgtgaatagaaagaccctttggaaccaatttggagatgtccttgaaaacgaggggagtatagaattttctccaaaagaagataagaaacctttaaaggattgtatctgcggaggggcaagatagtaacaaaatcttcgaagaggaaataagcctttacctcaccgctgttcaccttgtttgagggcttacctttcacagcatgggcccctgctcctggccctccccattgcctaggcagagtttcactcttagcctctgtcaagtgtgatcaccagctgacttatctatatctttttttttttttttttttttttgagacggagtctcactctgtcacccacgctggagtgcagtggcgcaatctcggttcactgcaagctccgcctcccaggttcacgccattctcctgcctcagcctcccgagtagctgggactacaggcgcccaccaccatgcccagctaattttttgtagatttagtagagacggggtttcaccgtgttagccaggatggtcttgatctcctgacctcatgatccacccaccttggcctcccaaagtgctgggattacaggcgtgagccaccgtgcccgaccatctatctcttcttatcagtaattgggcagtcttgatactgagcttcccagctgtggacccacaactaaattaatgtaagacccaaagatctgaaacgccctttaagatgccacccttgagaataaagaatgttagataccagcagaggtttatgcaagaagaagatggagtggtggagaaaaactgggagtaagaaaattaaaggaagagaaaataatagaaaagaacagtgatcatttgtattaaataatgagagtgaaaatagggctaacagtattttacaggtgtagtggatcacaggttgttgacatgtaaccaacaagaactggacgatatggctgcaaccctttgtctgcaaaagctcacatgtattggctagtaatgttcaagtagttaagaggacattaatcagttaaatatctatccacacatgttttctctaaaaaaattcaagtctccattttttttctgtctaatacttctgacttcaaggatagaatcaagagaactgggaccaggaattgcaactattgcaatgaggcaaatccccacaatgtcccaggtcagagttgagagaggcagctaaacaatgggactgtacccacctatgacatgaccttttaaaacagctctttttttgtgcttctttagatggatagaagtgaacttatatctatgctttgatttttgcaaaattcttagtctgtaaaagatatagttgtgactaggagactaactctcatttgcctcagtcctaaattcagtgtgttcagtataacattgaggaaataaaaatcataataatgatttcagaagtgacatattaactccatatttttgaaagaaagtgtggtcaggctctgtgctaaaaaaaattctacctactgatgttgcaaaagcgtgtcttgagatgatctttacaatgaaaactagatttctgtgaatgtgcaatgacttttgggtccttttcttttcatattcaaatattatttcccttctgtgatatttccccttatttatgggtttctttaatcatatgcatatattttttatgttgaaacctagtaaaggtataagcttttgtttcatttttagcatgaacctaagaagctcttccatcatgatctatggctttcattattgattctgtttatagacaggatataaatataatatgaaaatcaaaaacaagttttaaacaaaaattgtttttaaaattagatttttctcttcaacttaaatattttacccttccaaagggtgagggaagggggaaagatgaaagtggcagaattaatgtagaaataaaatgtttggagcagagcttgggctttttcccatagagtgaatactaaattttatcagtataatgatccatcacagtttaaagaagcaacacattttccaattacaatgataacttttaacatatctaacattttaacatctctgtatcttctaatatattagacttgaaaaattctgtagtgattgcttgtctcagcattttgcaaacatcatccttgctgtaccaaaacagagttcgccagttttggaaagatgtgtgcgtggctgaacctcttctgggactggacaacggacagcaactactatacgtgcaagtagttgttctctggtgagctgaaacagttactcacatcacttcccatgctctgaggttcagatgaggagcgctggtagagaaaggcagctctagatctttgtaagaaggtaataagacacgaaactgtgcccttcaatggaaagtattaatataatacatctctccaaggaagggctgacaatgggagttgaaagccaccagacagtaagtggctctcaaaatgagtgggaaggtagttacacaaagttggtgcccccatacttgtctggaggcctagctgaagaaccaatcctagcatgcccctccaatcatcgtggccactctaggaaccagccctagccacagccctactaggcaagagttgtcatgcttcttttacaaacttcgagtagacttaaagttttccttttgtcttcttcaccagagaaagaaaaagtttacttttggacaggttgcattaaagcactttagatattctcttttctctggtggaagcccgtatcttaggagacatggggaacctgctgctggctcacctgtcacagaactggatcatgaagctttcatctggtttttcccaggtgggcattttaaatttctgcttcaaagtctgtctttgtacttttaataaataagacatttgtactgatggaatctgcaagacaggcttgaaggaaaaaataaatgtctcaaagtgaaagtctgtttctttttacatgaacagtcatgtaaaaaatgtattaaaaatagcctttttgacttggagatctattatgttcagtagctaaactataacacagaagaccacatggagcacatacatgaaatattgttgaggtggccatttggagtcctgggttctagtaaggactccacttcaattggccgcatgatccaaggatgggcatatcacttctccaggacttagggtcttcatctctaaagtgaaggctgaacataacaggtacccttaaagctgcaaagcatcacacaacatttcacacctgtttaccctctcattctcttagataacactttttctctcttttctctttcctcaaaatgccagtgtctcttctcccagtctcattcttagctccctacttcaccagaaaactgaggcaatcaaaaaagaatgtccatgagcttccaacatcacattggcttatggctctgatctgaatgtgtctcctccataattcaggtattgaaacttaatggccaatgtgacagtattaaaagatgggcctttaaggccatgcgggctcctccctcatcaaagggataaaggtctttctaaaagaggcttcacacagcgtctggccctcttgccatgctaccttctgccaggtgagaatgcagcgaaaaggacctcaccagatgccaaaaggacctcactgtctccttgatcctgaatttgtcagcctctagaactgtgagaaaattaatttcttttcttttcttttctttttttttttgagacagagtttcgctcttgttgctcaggctggaatgcaatgacacaatctcggctcactgtaacctccgcctcccaagttcaagggattctcctgcttcagcctcccaagtagtgggcattacagttgtgcgccaccacgcctggctaattttgtatttttagtagagacagggtttcaccttgttggttaggctggtctctaactcctgacctcaagtgatccactgccttggcctcccaatgtgctgggattacaggcatgagtcactgcacccagccaatttcttttctttacacattactcaggctgtggtattctgttataataacacgaatagactgagaccaaaattgataccaggagaatggagtgttgctacaacaaatacccgaaaatgtagaagcagctttggaactgagtaatgggtagaggctggaaccgttttaaagggaatgctgaaaaagcctgtatggcccaacatggcacattaagggtgattctggtgagggctcagaacaaaaggagagctgtagggaaagcctgaaccttcttagtttatcttagacaagttcttatattatctcagtggttgtgacgagaatactggtagaaatatggacagtgagggcctttattatggtatcttaaagagaaatcagaaacaccttactggaaactggaagaaggccatcactgttacaaagtagccaagaagttggctgaattatgttcctgcctcagtattttgtgggaggtagaacttaagagtgatgaactaggatacttgatgaaagaaatctctaagcagcaaaatgttgaaggaattgcacggcttctctcaactgctcatagcaaaatgcaaaaagagagaaatgacttaaagatggaatttataatcaaaagggaagctctcacatgtaaagaatgtaaagatttgaaaaattctcagcctggccatgtaaataataaaaaagcatgtttagtagagaaaaccaagggtgtgcccagttgacagtccgataagcaaattagtgtgaatagcaggaagccaggagcaatttatcaagataatgagaaaatgaccccaaagacatttcagagatctttgaggccaccacattcttcacaggcagagtgctagggccttgggggctgaacaggtttgagggaggggcccagggtgcccatgggaacttggggcttaccatccagggccgcctcaaatctctgctccctgcattctggcacagtgctccttggctgccccagctatggctcaagcaggcccaggtgtgactcaagtcactgcttcaggaggtataggccatagcacttggcagcacccatgtagtgcgaactctgcaagtgcacagagttcaggagctttgaaggcctagcttcctcccctaggtttcagagaatgccacagagtgtctccaccagaggaatacacagtggagctgtgtgagtggggccacctcagagagtactcactaacacaaaatctagtggaactatgggggtagggccatgctggagacctccacattttagagtcaccaggatgcaatgccagcgtgaaagagctgcaggtaggagactccaacccatgagggctgtggtgtgggctgtgcccagcaaagctatggggttgtggcctttggagccttggggatccaacccctgccccagtctgccttgacggtaaaacatgagtcaaataaaattattttcaagccttaagatctaatgttgtttgcccttttgggttttggatttactcagaacttgttacccctttcttttagccaatttctgcctttcaggatgggaatgtctatcccacacctataccaccattgtgttttggaagctaataacttattcgactttgcagcctcattgctggagggaaatttgcttcaggatgaattgttccttgagtctcactcatacctgatttacataaacctctggactttagacttttgagttgttgttggaatgaatgaaaacttttggggctattgggatggaattaataatgtattttgcacatgagaaggatatgaattttgagtggccagagaagaatgctatgatttgaatgtatttctgccaaaattaatatgttgaaacttaatgaagaatgtgatcatattgagaggtgaggcctttaagaggaattaggccatgaggattcctcctccatgaataggattaaggactgtcttagtccattttatgctgttacacagaataccacagactgggtaatttataataaatagaaatttattggctcagtattctggagctggaaagtccaagatcaaggggctgactcctgcctagggccttcatgtgtgtcctttcatcgtgaagggcataaaaaaggggtgagagagaaaaaagcaggccaaataggtccttttatagggagcccactcccacaatagcagcattaatccatttatgaaggcagagccctcatagtgtaatcacctcttaatactattttaatgataattaagtttctaacacatgatttttgggaggacacattcaaactgtagcaaagcccttaaaaaacaggctaaatgcagcatttggctctcttgcccttctgccttctgtcatgtgcacaggcagcaagaagggcctcaccagacatcaaattctggcatcttgatttcgggcttcacagtttttatacctgtgaaaaaattaatcacccaatctgtggtcatctgtcacagcagcacaaaatgaacaaagacacttacccaccagtacctacaccctcagagtctgccttctcaccttttaacttttaaccttttaactacccttacacatatacaaagctcatacttcaactattcaaaaatagaagtcgcaagattagctcacctctggcctttggatttttccttggaagattctattagcatccagtcctgctatattccctatccttaagggcacgacaacaatagaacacaaacaaaaagaaacttttcttggctttactttctctgcgagctcctgtcccatttctattctcttttgcaacacaattccttgaaggagttatccacactcttttaaaatatttttctctgttattcttgtaaacacagtccaatcagatttttcagcactccccctacactgctcttgtcaaagtgtccaacaaacctcacattgctaaaatcagtggtcaactctcaattctcacattactcacactatctgcagcatctgatataattgattacgactcttccttgttaatttttttctggtttcagtcagtcttttggcattagttccatccatatgccactgacttccaaatgtggctctcttagccaacacctctctcccaaactgcaaactaaaattccaaaaggcttatttgactctttttagatgtcttagagatatctcaaacttatcaatgttcaaacctgaactcctgatctttgcattcaaaactttgtttacctgtaaacttcctaatctcatctggtggaaactccattctcacactagcttacaccaaatatttaagagtcagactcatttgatggtctcttatgagctcacacttgcagtttcactcctatggagctcagccagggctagaacttccattatggtttaaatcatatggctggtagttgtgctgactactggctgactctggggctctgttctcctccgtcagtctagcttagctttctatcagcatggcagctgcattccaagacataaaaaatggaaggtgtggggattcttgaagttttgtctttggagttgcacattgtcatttctaccacatgatattggttaaagcaactcataagattagtccagatttaaggggaggtaagatagagtctatgtcttgatggaaaagtggaaaagtcatattgcaaaagggcatgtaagatagaatggagtgttgcagtcgtctttggaaacaatcgaccgtataggacatcttcaaattacaaaataagctacttgccctagaatgtgccctctttccccttctgttacaagcacatgacccagctgtgattaggcagatatggaccataccctagggcatggaatagcaaaaagttgaaagaaacctgtacttggataatcatgcaaagctgagttgctcatcccatgactgttaggtaaagacaaaaaactttcttccatctccgtttctacccgttccctttcaccctcaccccttgtatctttgatgttccctgaactggccaggcactctccagccttagtccttttaattgttctgtccacctgaaacattctttccacaaatatctacagagctcgcttcttcacttcatgcaagggtttatttaaatatcacccacttaataaagtatttttgaccacactttttaaaataaaaatccatgactaatgaagactgacacacatttagtcctttgaacaatatctagataaaaatgtctgtggagtgaaaagaataaatgctgactttgctgttcactggttttcttcaggaaagtctcattatttctcagactacttcatcagaaaatggagataacaatggctttcttttacggtcattgtgaaacttagatggccccgtgtttgagaagtcctccttatgaggtcgccctcatgattgctcttcacttgagttcaggctcccgctctttgtcactcccctttgtggagacagacagactttctggagctgactaaccttgactaacctctcactacccaacccacatctggctacaggggaaagaacattgtcacaggaactaggctggttgtaccatccccacaagagtgtattcagattcttcttgagaagagtctagaattgcaccagaactctgatccccagcccaaaagcttgcatcaatgtggtatttttataaacatgtacatagtgaaatgactaccataatcaagctaattagcatatccatcacctcacatatttaccttccttttttattgtatgagaactcttaagatctattctcttagcaaattccaagtatacaatacagtattattaacaatagtcaccatgctgtacattagatctccaggacttatttctcttgcataactgaaattggactctttactcaacgtctcccaatttcccctacccccaacccctggcaaacattactctatgctctgctacctggatattttgtctctctacgtacattttagattgcacaaaataatttgctgttgtaatgaatggcattgcactggatccacaaatcaagttaggaagacatcttgacaacattgagtctctctatccatgtatatggaatagctctccatgtatttagttctttgatttctttcatcagctttatagctttcctcatatagatcttatacaaatttggtagatgcatacctatgtttttaatttctaggggtgctaatgtaaatgatattctgtttttaatttcaaattccacttgtttattgctgatgtataggaaagtgattgatttttggatattagctgtgctcttatttttatttccctcattttccttgttttgaatttactttgttcttctttcttatttcttgagtaggaacttaagagtattgacttgaggacacaaatgatgctgaatagccaaaacaatatttagcaaaaagaacgaagctggaggcattatactccctgatttcagaacatgttataaagtgatattaattaaaaccacataggtactcctataaaaacagacacattgaccaatggaacaggatagaaagcccagaaataaacccagccacttgatttttgacaaaggttcctagaacacacagtggggaaagcacagctttctcaataaatgctgtgggaaaaactgagtatctgcatgtagaagaatgaaatgagatccttatatcataccatatacaaaaattaactctaaattgatgaaagacttaaatataagacttgaaactgtaaaactattacatgaaaacagagaaaatgatccaagatattggtttgatcagcaatttttttggatataaccctgaaagcatagggaacaaaagcaaaaataaacaaatgggatgacatcaagattaactatcttaattatattatttgatgaatagaagtcattaatttatagaagttcaatttaataaactttaaaaatatttggtgtctttttggtcctatttaagaaatctttgcctatctcaaggtcatggaagatattttgtacttttttgttatagaatttgtattgtttttactgtctaagcttccacattgtggcctatgatccatcctgaataaatgttgctaaaaattaaactttgacttagcttactataaatgatatttatatttatgtattacataatttatttacatattctcatatgtaatacatattattttactataaacactataattaaggcagaatagatagtttagatacatattcatgaagatgccacttccattcaacggacaaaaggatagtcttttcaataaaatttactaggtcagttagatatctgtagatgtggtgggtaattttgtctttaaacttggctgggccacagtgcccagatatttggtcaaacattattctgaatgtttctgtcaagattttttcatttggataagaataatacataaatcagtggacttagggtatgcacattaccctccatagtgtggatgggccttctccaatcagttgaaagacttaatagagcaaagactggccgggcacggtggctcacgcctgtaatcccagcactttgggaggctgaggtgggcagatcacgaggtcaggagatagagaccatcctggctaacacggtgaaaccccatctctactaaaaatacaaaaaattagccgggcgtagtggcaggcacctgtagtcccagctactcaggaggctgaggcagaagaatggtgtgaacctgggaggtggagcttgcagtgagctgagatgccactgcactccagcctgggcgacagagcaagactctgtctcaaaaaataataataataataataatagagcaaagactgacacttcctgagcaaggaggaattctgctagtagactgcctttggagtcaaactgcaactcttccctgggtctcgagcctgctggcctaacctgtagattttggattaaccaagcccttacaattgtgtaagccaattttaaaaaataaatctcttgatatagataggtagatagatagatagaaggacagatagacattctgcttttctgctggttctcttttcctggagaaccctgactaatacaattcggaaaaacacgtatcttgacctgcacttcaccatgcacaaaaattaatttaaaatgaatcatagtatcctgctcatttttaattcttcagataaaaatttacctactatatctttagaataaacttttaataaaagttaattaaaattaagttttaattttatttttatgtttttttctctcccttgtgaaacagtagtacacttgaaaacaggagaattttttttaatgttaccaacgcagttcctggtaacaaatttttagaggctactatgtgtcaggctctgtgataagcattttaagcactttacttccataagtcctcggaataatcataccctcttatgtaagtattattatgaccaccaaatcacagataagaaaacaagcattagagagaaattaagtccaactgattctaaatgcaggacgcttgtacactaggtctccctacatggctcctcaataaataaattcattaagaaataagaaggggctgagcgcagtggctcaagcctgtaatcccagcactttgggaggcctaggcaggcagatcacgaggtcaggagatcgagaccatcctgactaacatggtgaaaccccatctctactaaaaacacaaaaaaattagccgggcgtggtggcgggcgcctgtagtcccagctactcgggaggctgaggcaggagaatggcatgaacccaggaggcagagcttgcagtgagccgagatcgcgccactgcactccaggctgggcgatagagcaagactccatctcaaaaaaaaaaaaagaaagaagatgggcttaaagtttcataaaatatcagtcatatgagaataaggaaaaggaaaaaagaatgtaaatgaaagataaagacagagaacaagaagaaaacacagcggagaatcagaaataaagaagattgttgaaagaagagaatatattactatatttatttattgaatatattgattaggctctgttctaggtggcgggataaagatagatgtattatctatgtaaataatatataaataataaatatatattacataatttataaacaagataaattatctatttatagtccaatcatgaagatggcacattaatacctgacaataacaggtagaaatagagccagtgaagatgagacagaaagcatcataaggatcgggaaacacaaggacaacatggaatgggctggttttggagttttaactctgcctcaagaagttatggtacttgcctaagcaaagaggtggaagtcttacagaaaaggaaaatatgaacggacatagctgagtgttggaagaaaagatgagggttgagctaagttgagctgccagggtagagagtagggcagaagttaatttccaacaaggtgctcagaaggatctgatcatggaaagtctgggttttatagatttcatccttttaacagaggagcagctaaagcagacctttcctttgggacgattgtcaggacggaggacacagggtccgttagagaagggtaacagaagtgacgaatgaccatggaagcttatgggtggtttaggcataaggtaaccagggcctgagaccagagaaattccagcagcaagagaaataagagaaaatagaaatgggaagtataggaaaaggaaacattttaaagctcttattccatctttgggcgaggttatacgtatacggtctagagttttttctcttgttgatggtgaaagggaataaacagcatgaaactcaccctggaggctaagatagtttgactcagagttccccccaccgcttgacctttcatgaccctgggtacacactaactctgaagttagtgggcaaggtgggcaggggctcatggactccataaaatccatctgactgttagctctgtctttcaccaggtgggggggccaggggctgtggcttaacctcattgtgcctcagccaattcttctgcatgtaaaatgaggatattcactatgtggccattgtgagatgatccatgaaaacctgtgtagcactgagcacagtgttctcagtaaatgctgagccctaatacccaatatacccacagctccatgcatgtgctccttagcaagcatacgcagacagcttggcttatctgcttgtgtcacattataaaagttggcttcctggttatttctacagtgcagcccataataccgatttccttaagagcaaaaaaaaaaaatgccttatttctttcctcaaaaatgagaattggccttttaaaacttttcctcaaatgacaggactggtgctgtaaatgcttatgaagactggtccctttgcatgtacgggcttatcttcctgaagatatgaagctgtggctagctgctttcttctgtttcctaacgaccacagaatgcacaaagtagaggtgcaagtggaagctgcaaagagctctacaacctctgtcaaggtgcttgtccttgcccaagctattactgttcttggtggagattattccccgctgatctaaaatatgctctaaggccaaggtgggcggatcacacgaggtcaggagttcgagaccagcctggccaatataatgaaaccacatttctgctaaaaaatacaaaaattagctgggtgtggtgatgcacacctgtaatcccagctactcgggaggttgaggcaggagaatcgcttgagcccaggaagtggaggttgcagtgaaccaagatcacaccaccgcacttcagcctgggtgacagagagagactccatctcaaaaaaaagtaataataaatacatcataaaatatgctctaatgttggagccaaaggtcagcactgtcactacacaaagcctcactttgagtagagatgcctgctgctgctatttcttgggacatgagcattctttaactgagtttaaaagttcttgaattataaatggatagaaatacagcttcacagaggtatgctcataaaggagtcttcacacttgaagatacagtggacacatacacacacgcacacacacacacgtttagagaagttcccttaatcaatctgacagcatgtagttataaaaaacacaaattggccgggcgcggtggctcacgcctgtaatcccagcagtttgggaggccgaggcgggtggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggctgagcttgcagtgagccgagatcccgccactgcactccagcctgggtgacagagcgagactccgtctcaaaaaaaaaaaaaaaaaacacacacaaattttatgaggtgacggtacagcttctgcttccctatatactatacctctggagaacgaagagcactgaatactatatttttactttctatgtttggaactacacttattatcatgccattactcaacaaacatgcatcacaatgtccccataccaccatgaatgggcacaaataaccccatcctattgtggtggggttaattttttaggacagcaggtgctgtccactgttaagagcgtcagtttgcctgattttttcaagtttattctccaagagcctttcactcaggttgggtctgcaaagcaccagcaagtccaacaactcaaccaaatgtctacagctgcgggtggcagataagtatagcagctaacccaaagcaaataaaaacaactcctaggggaaataagagggatgctgggagggctttttatttgagtgccactgtggtcttactgatttgagtgcccacttgtttcagaatttagggtgtgggagtgaccaaggagcacagtgactagaggaaactagaaacaaaatagacattgttcactttggttgctaaatttaatatgtccctattgcactttttgttttgggaaatttttccaacattaagaaaagcccttttaaagaagagtgttaaaacattggttacatgagaaccaaggaggattcaccttacaaggtgaaattatgtgttttattcaattttcacactactataaagaaatacctgagactgtgtaatttataaatgaaagaggagttttttgttttgttttgttttcactcaaaattcttcagtttttacaaaactaacagggtggagtggggaggctggggggcaggcagcctcaggagtagggctggtgagaggcgctatgcttctgtctccacctgagactggctccctgccgtgttgctcttccactccgccttcatctctgtgtcagtgggatggtctcctgagcaagcctctgccttggccttgttctcctcctcagccagcctctcaaacattttggcatagaacttcttccgggcaagctgcctgtggatccgctgctgacacacagccagctgggccctggcggctttgttgttggggtagagctgcaggaccttctggaagtcagcccatgccagttcaaagtcattcaccgccaggtgggcctctccccggcggaaggggcccttctcgttgttgctgtccagttctagggccttgttacagctttcaatggcagcagagaaggcctgtagtttcagctgacacatggccaggtcgaggtgagaggccagtggaggggcctgtgccttctgtgcttcctcattggaaaaactagacatattccagccaggacacaatcttcttacactgtagtaaagcttgcttgtatttgccttccttgaagtacacactgccctgctctttcactacggtgttctgttccagcttctcttctgaaatcatctcccaagattccttggccttttcaaaactcttgagatataattcatatttcagctcggcatttggtgggatttggaacttttccttcccaacactgccaaaagcatagctgggcttgaggtacacagtggaatgttctcctttctccaagtgctgaatggccctctcgagatcataaggcagatccaggttctccccctcactaacctcaaagcggagcgcccgttggtcaaagagctggtccttgcagcacccttccagcgcaacctccaccatagcgccctcatcgggcttgacatagccttcaccgtgagtccctattctgcggatgattcccccatctttcaaacacaagcgtggcgttatggggagatcgttggaggactgtctgctgaactctaggcatattctggtttgcaggtgatgtggcccacctcccccaccttcatggttgctacggcaatgtcccaagccttgatgacctccccttttcccaggtcaaaggagaatttgtccttgcgatccacactggagtcaaactttgtgccctctaacagccagccagtgtagtggacaaagactaggtccccagtcatgggcatctctgtacctgtgccctctgtcttgatgactttcagcactccttcatcctgtttggggctgacatccacttccttcttgggcagcggcaccggctgcgccgcactctcggtcgccttcatctccttggctgtcatctctgcgtggcgcgaaatttttccgggagatggcgcaggcgcgagtgcactctgggccgcaggcgggggcgctacctgcagggcatgcgggaggacggacactaccgcgctgactgctgaccgcgcggaggctggagcacctctcaggaaacaggtttaattgacacagttccacgtggctggggagggctcaggaaacttacaatcatggcagaaggcaaaggagaagcaagtatcttcttcacgaggcagcaggaaaaagaaaacaggcgaaacttcctcttacaaaaaaaccatcagatctcacaagaactcactcaccagcaccagcacagcatcggggaaactgtccctgtgatccgaccaccccccaccaggtccctccttggacgtgtggggattacaattcgagatgagatttggatggggacagagagccaaaccatatcagtatgtctattcagaaaaatgtttatacatatatatatatatatttttttttttttttttttttttttttttttttttcagagtgttactctgtcacccaggctggagtgcagtatcgcgatctcggctcactgcaacctctgtctcccggattcaagcgattctcctgcctcagcctccagagtggctgggattacaggcgcccaccagcacgcccagctacatatacatatatgtatttttagtagagacagggtttcaccatgttggccaggctggtcttgaactcctaacctcaggtgatccgccagctggtgtaagccactgagcctggccagaaaaatgttatttatattctaatggtaccaacttcaatacgctttatcactctgaaccacagttttttaatttaataaggaaaattgggtagaaaaatatattaaaatatatattaatctatcaaatactacacaaagacaagtctttaaatgggttgggcaatatgctgaagttgatcaccagtaaaacgttgagtaacccctccatagaattcccatagaaatctcttcgttaccataaacctaagatcattgctctctctcactaccacagggatgtgattttagcatttgtatccaatttaccggtagcctaagccatcagtgagatatttggcattctgtatctaagcctgttccctcaccaccacacttcttcatttctcttggttctattctatctgtagaagacactgaaaagtgacgagatgtgctgttgaaaatctgtttcaaaatcatacactcattgctcactaaatattagctcttcagtcccctggaggtacctgggatcagtctctcccgcctctctatgtagaagagggaggggtactctgactgttgggcagttgtatattctctcggttttcaaaaatgtctactaattaaatgccattggacatgtgctcctacttcctgtgggggatgagacacagtgtgacacaaaagacaaaatgtcctttctgtacgttattatgtcgctttgttcatattctgtgaccctacacatttataatgtcacctttacctttcattatgttcatatgtgcacactatattctgagacccctcatttcattgttgatttgtccatttctgaacaaacagcagttttaattattttaacttcagacttttcagtacgaaaagtcatatctgatttttatcttgcttgaaaatgcttcttactcgtattctcctcaggatgaaattcccctcatcccgatactcagtaacctcattcattccatccattccacctgactttctccccatctattagctcctgctgtattcgtttctcatcttatcaagcttaggaagaatatcgtccattatttaccatttcctctcttgtatcattagtcaaaactgtgtttctccaagtgtggtccatgaaactattgcctctgaattaccaggggtacttgctaaaatgcatattcctaggccccattcaatctggaatgaatgaagcttgaaatctgcaaatggaatatgcgcctctgaagtacattatcatttgatagctgcttccctagcctctctgcccatcgcatggcatcactctcacaaaccctgactcaggatgaacctgcctttctgccttcttatggcctttaactaactggggtgagtggtgtgactgaacgagcattcaccacaatccacttcaacaggcttcaaacaccactgataatcctgatacagaagtcagcatctgccacacattctccctatcagcagtgacccaagtgttcagtcccagccagtacctcacttcacttatattaagtttcctttaatgggccactgttgctcttttctcccaatacttgtgagtctgagacaccctagtttatcaaacatgttctaaatggcactgaagctcaaagagaaatggtctggatgccacttcccttctgcacaaatggctcttttatatctctataaatttgcaaatgaaaaatagatacttctagaagcaggagcaacctcacttatcagaccattgataagacaaacatagttacaaccatcccctgaaccatgcattgggcacttgccttatacctgttatcatgagaggtactgtccaagtggttcatgccagagaaaaagagagttttcccaatgtaaatgaaattaacctctaaggatttaatacttctagtaatttcaaaatgattttaaaaaattaaacttcttctttgctccttaaatttccctgtacctcacactataaatgagtgcacaagaaagataaaaaaaaagatggcactaaaattttagctgttatttaggaatgatgaaaacaggagtgattttttaattattatttttacaaagtaacatttattaattttgtaattagaaggaagaaagataatatttatttcacaaatatgctccaacttgaaaatgctttgaagatgaggggtgaggtcagcagcccgctgtgtcagtaaggtacttcagccttgggtcctgtacacacttacaacagcaggaaaatctggtgctttgggaagaggtgtccacaggggctaaggcacaaaataagagggctgcatatggactgtgtgaagtaataaattcctgaaggcctgcttattctatgtatttaatatttaaaattacccattcaagcatggaaaagacaatttagggcctttataaccaaagaggataagaatgatctgttctccttaatggaaccccagagactagaatttaactatttcctggctccattccacttctaccaccccaatttgagtctagaactcaaagtaccattcatcctagattctatgcacacgtacaaatcatcacatttgttttacctagaagtgtaatggtaacttagtgttgcaagaaaagccctatgtctattcagaaaatgttatttatattctaatggtaccaacccctcccttgacttggctctgtaaccattctggtaaaaaggaggaattaaggtaaataagagggattacgggttgaagatggacaatcactcaaaacttgaaaagaaaaagtcactccactgcctaaagcacttcaatgattgcccattgcattcagaataaaattcaagttgcttatcctgacctttgaagccctaaacccttccattcctctgcctttctcagtttatcttatgccagtctctctctatgccatcctcatggacatgaatagtcttctttggtctgaagattattcttggttgctttatatactgcttaataataagaagacatttgccccctttgaattccaaataagataaaagaagtgactggatgttatcacaagtacaacatttctgtttgggaagtatggaatacttctcacccataaaaaagaatgaaattatattttttgcagcaatatggatggaactggaggccattatcttaagtgatataactcagaaacagaaattcaaagactgcatgttctcacttataagtgagagataagtaatatgtacccatggacatgaaaagtggaatagacattgaagactcattggagattttggagactccagtagacactggaagggtgagagggaagtgagggatgagaaattacctgaaaggtacactgtacactatttgggtgatgggtacactaaatgctgaggtttcaccagcacacaatatatccatgtaacaaaactgcacttgtacccctaagtctatttttaaaagtgattaaaatccatatgttctccccaaccagcatttgccagaacaatggtccccatgcgcctgcagggacttgaccaactattagggcaaaggcctgctacttatctacttccatggtgaagaaaaccacaacagctttggtgagcaagaatgtggaatcctttgaggaacctctgctagggtccaacctgcagaccctgacccagcgatggatgaatgaagtacactgacacacagatattctgctttgccagtccagctgagtgtctgagccacctacagactcccaggagagtactgtaaacagttgcaactcctcgatcagtcagtgagacttgcatttatttagtaaagattaattgacaaaggtcataggaaaacaccattagagggtaattgacattgtggacttcctgagtagaaagcaattaagcacccagggtacatcaaaggttagtcttaggaaaacaagttagttagataaactactctacattattttgtatttgtgccttaagctctctagctcctgcaaagagactctggctgccttcagccagacaatcagaagctatgcaaactctcaggctttccaagagagtttgtggctattactataactatcattaatatttttccaactggcctgattgaacccccacaaaactcaacttcagcagagagctggaagcagggtaaggaactgcagttgccattgcaattcattgagaataaagagaaactaaagggacttcaaactcatttgaataaccttagtctctttgtgtcgtagaatattcttaaaatactttcaagataaatcatgatatgactcacagagggaaaagatctgtcattttggagaccttaaaatacttgatttttaaaaatgtgtgcattttacttacccttgtgatataaagtactaagatttcacaggggttgtgtaaaaatgtgcattttatattcagagaaaaggctgcaagcacagagatgtcacttcagggattcagtttctagttgttatcttattgtcaatcctttcagcttggtcatctctatatccccacacaccagctcattaaagtaagatatttgctatgttttatgtataatatagagaaaagcagacatcactttccataactcatatgtttctgaaatgatatgtactctttgtaagactcagaaatcatccctctctgcttacctaattaaaaagtagaaaatcaaatatttctggtatgatgctgcttttcaccattttaaatatgactagaaaaggcttgcatgcaccttactgtagaaataaaggtagactacccacatgagaacaggtgattaattcaaagtttgggagtgggaaagctttagagtgagcaaaaaacgggagggaaagcgtgggggaaggcttcaagtatgctctgattgcatgtagttggcaaggggaagttggaagtaggttaactagaagcagagtatcttatgtggttggtttggggaacatattttgctttatttggttggttctaagttggaaacaaggcaaaatagggaagctaacagtcattaatgatatcctggaccatttgggaccaatcactgccaatgatgtggtttggcttcctggactggtggcttcagagattgtgaatcagaattctattgtcatatcatctgaccactattcatttgaatatttatcctctcagccccccattacggtcattctcttacgagagattgaccaattcaggggcagctagaaacccacatcttcaccactgtgatattgccgagtggtctccattacaaactatattgtgaggtcttgactttttgttgttgtgtcagcactgagatgtgaggtcagttggacttcctgggtccagtggggacctggggaactttcctttcttacaagaggattgtataaagcaccaatcagcactctgtaaaatgcaccaatcagcactctgtaaaatgcaccaatcagcagattctaaaagtagccaattgcccggaggattgaaaaaagggcattctgacaggacaggaacagaatatgggaggggccaataagggaataaaagctggccaccccagccaccagtggcaatcagctcccccttccatgctgtggaagctttgctcttcacaataaaccttgctagtgctcagtttggttctgtgccatctttaagagctgtaacagtcacagcgaaggtctgtggctttattcttgaagtcagcgagaccatgaacccaccagtaggaaccaactccggacacagtatggcaatgatctctggtgagaacagctgcccagtagaatgtaagacttggcagaggttgtgatggacctgcatcatggcaggtatgaccaaagtgttgcacgttttgtagttccgtgtgcagggtggaatggcgcccagcggctttttctcccctgttgcttggcgagtgagagggagggttacagtgttacaggattcgttcagtgccgcttcaccagctggaaatctctgtggctgcactgacttctgttccggcccttgctcaggcctgccgggttgctctgcccacttggcccagcaggctgcgcttggctcacattactggcccagatcctgtggtcagtgtggctgcgtgctcagctcgtagctggactgggcatgctgcaattggcttccatattgggcgctggtatctagatgaaggggaggtggtggcgccggaatacttggagatgacagcaactacaaagccccaaagggtgttacagcttttgcttggggagtcctgaggtctgagccccccggaaatgttacagttctctctggttcctgctgcctgcagctcagtgaacaggggtgcattacatctcctttgttactgccacccgcagcttcgggagttcccacaaccaacaagaataaggtgtgtggacagcagagagtcagaaaggcagagaagaattttattgagcgacagaaaagctctcaacacaagaggggacctgaagtgggtagacttctgtgtgaaagggggcctgaaagccggcagccatctgtgtagctgagtataggatttttaagggctcagaatggaggagtgcatgctgattgggccgggggtggtcttggaaaaatcaccatttattggttaaaaggcatagaggatgttctcactccggttgtggactctacctagaactggcagttgggttttcaggggtcaggctgtctttggcttaaaggtcgggtttcaaaaacaaaaataatcactagtccctataaaatgctacagaagcagaaattctaattttccaccccagaccaagagaacatataggccacagaccatgaagatctgccttagaatggcaattatcttttttccataaggaaatgtgagatgtagagcctgttttactttgcctgtttcgttgattcaaatatagtgagaagtattagcaataacacagagctaccatgagtagccaacaagaaatctagagaaatatggttattattacttgtaacaatagagacaatgtcattaataacttctgccagagttattggtgatgaaactattggtgatggttttcttacagtttttttctgtttgtacaattctcactctgattattcacacagtgagtcagtaactcccccaggtagactgcctgaataatcaagggtggccgcatttggaagctccagtctgaggtggaatttccagacttccgtttggaaactcgggttggcccactgatattttataatggcctatctgaatccttagaaacttctcctttgaagatttacagaagacaataactttaggccgggctcggtggctcacgcttgtaatcccagcactttgggaggctgaggcaggcggatcacgaggtcaggagatggagaacatcctggctaacacagtgaaaccccatctctactaaaaaaaaaaaaaaaaacaaaaaggccaggcgtggcggcgggtgcctgtagtcccagctactcaggaggctgaggcaggagaatggcgtgaacccaggaggcggaacttgtagtgagctgaggtggcgccactgcactccagcctgggtgacagagcaagaatccatctcaaaaaacaaaaaccaaccaaccaaacaaacaaaaacattaactttagttaaggcttttttttggcataacgttctgttagaattttttctttagtttttctattaccttctttctttgtatgggcctcaaccttaaaatagccaactctagaaagtagagtgccttaacttattcattttcatggggtttccagcagagatgatgaatttctttttttccccaaagcatcccaaattcatgtagtactctaaaagcatacctgctatatgtttactacatggtcttcagctaactgacaagctctagtaagtgtaataaattccattatatgggttgattttacctcagatagaaaatatattctaaagtagagcttaaattagtgataattttcaatatcagttttgaggtatgatccatcaatgaataacattgaatcagagttcacaatgagagccagtctctcatcaatctgagtgaggtacagaaactcccctgacttataaccatcatgaggttcccttcttctggcagggggagaagagtggcagtttaaggaattgcatcagtgaatagtaaagcgagagagagggagtaaaactctcataacaagttgatcagctggttgaaaagtattgcatgctctttgtcagtggttatgtctacactggccagggaatcatgatgtgaggtggggagcctagaaatagtttaaaagaagcaccaacaaatgttgcagtggaagctgttgccttaagacaagggctataagcctttgcagctgggtcaagggtaaggctatggaaaatgatgaatttttgatggtttccatgacattgagttaaaaacaaaaaagcttgtacaagttatccatgcacaattagacaaaatggcatattgtagtcaggggtgcctaattatgaaagagagtgcctaactaccaaaggaagaggctactgaagagccttcttgagttacagaatttatatttgggcccccacaaaagacagtttcttactaaggactcagccaattcataaaaagagattgcaagctcagaaaaatttcgcagccattgtctacaatatccagttaaacctagaaatcctctcaattgtcattttgcgaggcatcgaggtgaagtttcgatagtgttctgcctaccaatagaggcaaaataatttcaccctcttaagataacttacaccctaaatactagcctgtcttttgacaaaattataatttatcttttgaaacattatgttctttttctgctatggctgagagcaagtatttacttgctctcaccttctcaccagcttcctcgttctctgaagaaagcagtggagatcatctgatcctgcatatactgcatcaaaactgaatcacaagtgaaatttagatcttttaagtcttgattgaggacttgtggaaagtaagagggggctttagtgagcccctggggtatgactatccgggtatatttgttgtcctctccagatgaaggcaaagtcgttgactgttctggtttggaagcacactgaaaaatgcacagtaaagattcaatatggtcaagcaagtggttttgggcagaattgatgacaggataggtactactaggaagcaaagcaaaacaattttgttgatctttcctgaggtcatgaaaaaagtgtaccagcagaacaagtgtggtgcatgggctactgcagcgtatgagaaagtctttggatataaggtcatcaactacagttttgaagcattcctttgcttctggtttttcaaggaatatcagggaagtttgaccatggtttactaggatacttctgaacttgactaggttctgctccaataatttcccatataaatggatttttttagtttgtagagtgttaggtagagtgttgaggtctttatctggagcgtatgtcaaatataatgaaggagacaaacatatatccagagacgacatatagaggaaccctcaggagactctgctgtgcatttattatttttctgagacagagtgttgctctgttacccgggctggagtgcagaggtgtgatcttggttcactgcaacctctgcatcccgggttcaggtgatcctcccattttagcctcccaagtagctgggattacaagcatgtgccaccacaccagctaattttcgtatttcttttttttttttttttttttagtagaggcagggtttcaccatgttagccaggctggtcttgaactcctggactcaagtggtccacccacctcagcctcccaaagtgctaggattacaggcgtgagccaccatgcccagctggtgcacttactattataattctatttgaaaattaagtcactccccattaaatttgcaagagtgttataatagagcagggagaaatgtttttaagtcaagtacccaaaggttgtagttacagtaggagatagaaggaatctgtgggttatttgagatacctgctacttgcttcctatgaggaaaatgttgagcaaaattgccagggtttaatgtagaaagagttagtgcctggctgggcatggtggctcacacctgtaatcccagcactttgggggggccaaggcaggcagatcacctgaggtcaggagttctagagcagcctgaccaacatggcaaaaccccatctctactaaaaatacaaaaaaaaaaaaaaaaaaaaaagcagggtatcatggtgcatgcctgtagtcccagttactcaggaggctgaggcaggagaatcacttgaacccaggaagcggttgcagtgaaccgagattgtgccaatgcactgcagcctcagtgacagagtaagactccatctcaaaacaaaaaaagaaagaaagaaaagaaagagtagcgcccatattgccaggaattgctgaggttggccacctatatttatggttaattcaccttgaatgttaaattttaaatcaggatattgggtaccttcattgatgtaaattaaggggtcttttggtcttatttttactggaaaatcatttttcaggtgtcccttctgttttcaatatctgcaggtgtcctcttctatgggtcgtccactcaactgtttgatctgcagggccgtaaggttattctggatcctgtcttgttattgtcctagggctctgcaaaaatgtcagccaggtgttgaagttcaggtaaagtggctatttcccattctaattttgatctaattattgtctccaatttcaggtttaattccattaacaaagtaggtaaaagagccattattacacttacacttctttaacactcaaatgttgttgaaaggggttttctagtttattctgaaaatctcctataatttcttcttttctttatttacatcattaaattgtggtccattttatttttactagaaatgtttcaagtaaggcttttaggatacattgccctactttttgagcctccttttggccttcaggcttattgtggaaagaaagatgctgtagatctctgtcccggtgaatccaactggcttttgccatcaggatttaatgtctgaggatctacaaacataaatacaagttgatatagttcaggtaaccctgagttgtgtacagctaaaagaatttagaattctgaactcctttgggaaatgcttagtcatagcttttaattcagctcgtgttcaaggtttaaattctactgctgcttgcgtatttgggtcattgaagagatggaactttagaggtaaatgacattccgggatcttaggagagtcactgggagaaggtagggggtctggaagaagagggaggagtcaatgaggtgtgaaaggaggatgggggaatgaggaagagttgcagagctgaagtcaactggaggagaagccgggggaagatttgctgggcaaatgagttagtttgttgttaagtttgtcatactgttcattagctctggccaaaaaatattttaacggagtaatgtctgaatcagaatttcatttgaaaacttgtgtaccaatcaaaaactgctgcccattgcccctgagaaatattctctcttttctaaggtgtttttcaaatgaacaattttgttcaagtccagtgttctccagattagccactgaaggcctaaattatccttggtatagagatgggtgcaagtgctaggatcatagcaagggtacatataagaaatgggagattttcctggaggaaaaaaaggaaaagaggatgtacactcagaaaattccatgggagctggcaatggtcagttgaaagtaatatttgtgcactttatgtcttaggcccccaacctgatagttggcaacctccaaatgcagacttgacaacttgtgcccacaggcaaatggaaaaccagaatattccctctgcatcaaatccaacctctcagggccaaaaaaaaaaaaaaaaaaaaaaaagatgaaccttatcccattttattggtgactgacaggaaagtttaggaaagtttgtccagatggatgctggtttggtaagaattgcagctcatcagttgtggagcaagctgagacactcttagaggagcaatgcctgtgttctgcactgattctccttctgataacagacaacactttagacttatctcacaaaacagaagcacaaaagagaacaaaaaggaatgaaaagaaatggcagtatttttccaaaggtgccaaacaaatgggaattggtagcaaaagctgagtaccaagctgagagtcaataaccaaggatctcaatacaaagagaacagagttgaagcccaattctgttctctcacagacactgtgtcaacacagacttgacaggcctcaagaagcaaggcacaagaggcctccatagataccgcacttgatcagggtccaaagtccatggtgatgagcagttaagaatgtgtctcagtggagcttctaggaaaattacagaaatacagaccaggcatggtggctcatgcctataaacccagcactttgggaggctgaggcaggtggatcacctgaggtcaggagttcgagcccagcctggccaacatggtgaaaccctgtctctgcaaaaaatacaaaaattagacaggtgtggtagcacatgcctgtagtttcagctacttgggaggctgaggcaggagaatctcttgaacctgggaggcagagcccagatctgcagtgagcccagatcgtgctgctgcactccagtctgggtgacagggcaagattcagtctcaaaaaaataaaaaaataaaaaaaacagaaaattacagaaataaaggagacaacttaatgagaacagaagctatttatttcttgcttgctagagaaagggaggcagtcgctatcatttatgtttgacagagactcaggctgggagaatgggaaagctttatagtgaaaaggggcaaggctttggggtaggtggctatgggcatggagaggtgcaggtaggctaaagagaagcaaggcatctgatgggataggtttggagagagtatttggctttctttaattagtactaaactagaagcaggggcaatcttagagaagttggcagtcattgaccaacctctgattgttttcggcaaattgctactgaatttgtggcttgcattcctgaactggctgctgcagagattgtggtttgccttcccaagctggttgctgcagtggttgtgggtcagagttccattgtcgtacgtggtttggccactgtctgttttaatattcagtctctattactaaaaggtatacaaatggctaggcttctcacttcagttcttcatgtacaagctccttttagaggtttctgcactaaactattgtaaaaaaaaaaaagaaaaaaagaaggccaactccatttatccaatgtcaaccttgacgttaagaatgatgaatgtggcagctgtttccttctgttattgatctttttactgacccttcccattgtgctttgtcaatgactgagtatcttccctggaccactcttatctgaagtcgtcctcatctctcagggattttcagcaccatctgtcagccaggcactgtgactctgtcgtcagtgaccatttttattgacttttgtctctttctggcctttccatggtgccttggccttaaatgtcctgctaattagctcagtggtgattacagtgctggttttgagagcaccctgttgttttttcttatctaggagaattttttttctctctttatctggaaatattaccttgctggctatgctgagttaggtcattgacatcagatcagtgttctaaatctgatcctagtattcccatctacaatcttcccacacaagccaagggaagagacacacttgattaaaaccttgcactctctttcctatttggctattttttctcctcttggagaaagagtttccccaaaatactatatgaagtgttattttgtaagcctacttaacttagttttatatactgtgcacaaactttacatataatttgaataggctcagttttttgttactgtttttttagtttttcaccaaattttatatgacagactatttaagctaaataatttgttatagttagaagactgttttctcatttacataccaaaatctaccaaaatgaatttattacacttaagaatttttgttaattacgattatcacttctgtaaaataaaataaatctaagaattttatgagcaaagctttttcaagtctactatttagtttagcaattattctaaatatcaatctcaaaattagagtaagggatttccccttttaggaaaagatatcaataattatatagtaaaaatttaaaattaagatacagacatttattctgtgttggatcccaaatatctcattagagaatgatcttctctcattgtctgctattttctaaaatacaggaagatataaagtataaatctgattttttttctaccagaagttaaagaacatagaatatatttggtatgattaactgggagtttgtatttcctctgcaatctagaaatattattattttaaatatctgcaatattatttattttaaaagtttttagtttgaaaatacatttctgaaagccccaaatctgtgagcatttgctactacaaaatttttaattgtaagcaattgagagagaaaagtcctcgaatttggccaagcgcggtgtctcacacctctaatcccagcactttgggaggctgaggtgagcggatcacgaggtcaggagatcgagaccatcctggctaacaggatgaaactccgtctctactgaaaatacaaaaaattggccaggtgtggtggcgggcacctgtagtcccactactcaggaggctgaggcaggagaatggcgtgagcccggtaggcagagcttgcagtgagccgagatcgcgccactgcactccagcctaggtgacagagcgagactccatctcaaaaatgaaaaaataaataaataaaagtccttgaatttatgcaaatgacatagcaatcacttcaactcttaaataatctaaccatcatgagataagagaatggatttttttctactcgtttgtatcttgtctttttgaaagagactacttgttaataatatgcttctgacaaaacaaaaactaaggaaagtgtatgatacaggcctgagtctctctcctcaagttcagtttttaaaaataaagtataatcagggataatgtagcctctacttgtaaaggaaggctggctttatgtattaatgaaataggcagcttcttacacgatgtgatttcaacagagccaggaagtatgtcttatctttaaataactccctaaataactccttctaacaccaatatctgaaatgttgtgactgatttctttctgtcctgccctgaagttctttcctgactgcaaagaacagcacattttgaatgtttcaaactgtcatacatgttctctccagaagagtggagtgatgccccaccagacattctaagtcacaggataacatgacatattccatgattgtcagttttaccatgtggcaagtagttaaaaagatgaagtttatagttccaagaacacaaactatgttatggaataggactaaacacaaggagtaaagtagtcccttgtttttgctttaggttactcaccttgctatcagtaattgtattcactgaagtattgaggaacacattaacgttggtttcagatttgttgactttaagttccacatctgaagtatgttggcactttgaccttgcataattcaaagtcatgtctctgcaccactgtttcattctatataaagtgattgacaataatagttatcccacccaagttggacttccatttctgtcaattggccaaactgggtttcctaaaaagccttgtagcgctacaaaatatcagaaaattatatcaagtctacttttaagtaaatgtgaagctctcaaggaagccctgatggcaatccagaaatagataaaagcagtacaggagctacagttgcctggggaacagaaactgacctgggttacccagagtttggggtattaacaactactcaggggaaagtaaaagtaggccttggacacataaaatgttgggaaggctgagccagacttcttgcatatagccgagtcacaataggctaagaacatgaatttaggaaggaaagcaaaaaaatctacaagcagtatgaaaaaaaaatctccaacaccttgatacattttaatgaatcatcagatgacaaagaaatatacaaattcttgaaagtgccagagacaaatcagagattcctagagtgaaaagaatgtccaccttttaatggggttgtttttttcttgtaaatttatttaagttccctgtagatgctggatattagacctttgtcagatggatagattgcaaaatttttctcccattctgtagcttgtctgttcactctgatgacagtttcttttgctatacagaagctctttagtttaattagatcccatttgtcaatttttgcttttgttgcattgcttttggcatcttcatcatgaaatatttgcccatacctgtgtcctgaatggtattgactaggttttcttttaggttttttataattttgggttatacatttaagtctttaacccatcttgtgttgatttttctatacggtccattttctgcatatggctagccagagttctcccagcaccatttattaaatagggaatcctttccccattgcttgtttttgtcaggtttcttgaagattagatggctataagtctgtggtcttagttctgggttatcgtttctgttcccttggtctatgtgtctgttcttgtacctgtaccatgctgttttggttactgtagccttatagtatagtttgaagtcaggtagtgtgatgcctccagctttgtgttttttgctcaggattgttgtggatatttgggctttttttttttggttctatgtgaattttaaaatagtttttttaattctgtgaagaatatcaatgatagtttaatgggaatagcattgaatctataaattgttttaggcagtatggccattttcatgatattgtttttttcttatctgtgggcatgaaatgttttttcattttttggtgtcatctctgatttctttgagcaatgttttgtagctctctttgtagaggtctttcagctccctgattagctgtattcctaggtattttattcttttgtggcaattgtgaatgggagttcatttgtgatttggctcttggcttgcctgttgttggtgtataggaatgctagtaatttttgcacatcgattttgtatcctgagacttcgctgaagttgcttgtcagcttaagaagcttttgggctgagatgatggcattttctagatataggattatgtcatctgcaaacagaaatagtttcccaagaagggagttaaaacaggaacatctcacagccattacagaaattgaagtatttatgtatctcaattaaaaccaaaccatcataaacgtatttctttgaaaaatatctttttttttttttttgagatggagtctggctctgtcgcccaggctggagtgtagtggtgccatcttggcttactgcaagctccgcctcccaggttcacgccattctcctgcctcagcctcccaaatagctgggactacaggcgcccaccaccacacccggctaattttttgtatttttagtagagccagggtttcaccatattagccaggatggtctcaatctcctgacctcgtgatctgcccacctcggcctcctgaagtgctgggattacaggcatgagccactgtgcctggccgaaagatttcatttttaatgcctgctaaaatattccactgtatggatataccagaacttactccttgacttagtaattaaatgtatttatattctgtcttgagtttgcctcccatgtttcaaatatactagtcttctcagttacattgccaaggccattatttatatttcgatggtattctcagcaccagctgctgtgatctttgaaatgtattcttgaccttagatgctcactgcacacttgacagattgagaactgagtagaggtgcttgttagtatctgtatctcagtggctggggacagctggactcagcttgtgtgactcatgcaaagtcagatgatcagtcatagagggaacttggaacttaaaagtgtaaactggaacttacgcttttaaaaattattctatctcacatagtgagaaatctttatgactctttagtctacaaaagggatcagtgaacagtttctgtaaggtgacagatgatatggtatagagtagttccccttatccatggtttcactttctgtggtttcaattaaatgtggtcaactgtggtctgaaaatattaaatggaaaattctagaaataatgtataagtttagattatacgctgttttgagtagtgtccctcctagaacacgaatcaccactttgtctagcatatccatgccttatacgctacctgcccgttagtcacttagtagccttctgagttatcagattgactgttgaggtatcacagtgctgtgtttaaggagccctcattttacttaataatggcaccaaagcacaagaatagtgatgctggcttattgttagaattgttctatgttattagtagctattgttgttaatctcttaccgtgcctaatttataaactttattataagtatatatgtaaaggaaacacaatatgtatagtgtcctgtactactgaagatttcaggtgtccactgaggatcttggaaggaatcccctgtggataagggtgcaccactgtaaatatgttcagctttgagggcaacatagtctctgtcacaactgctctacctgcaacagcgccagacaaatctggctaaactttaatccaacaaagttatgagttggtctgagccctcaggctgaaggtcatgtaaactgagcatgcccagatgaaccaagtatgcaaccacaaggggaagagaagtgcccagaccaaggagaagaccaaggagcagggactgacttaagaagcagacgcagtatggaaggatccaggatccaatcaaattgagctctggcatcagcccattgtgggatcgaatcagatcatgcctcctggaatcatctcattgcagaattcaatcagatcacacctcattaccctatgcttataaaaccctacccaaacaccagctgggggtgatatattggagcacttcctcctgtctccttaccagtccacttgcaatgaagcttttttttcctcaaaagccagtgccatggtcttggcctccatgtacattaggcagcaagcccattgtttgctcagtaacaccctacatttgcatccctttgtatcgtgaaaacagccacagagacaatgtaaatgacttttatctcatttaaatgaattgtcaacctcagctaaattactacttatcatataaacagaaaatgtaaataaactgattatttctttccatccatgtttttactgtcttcatgtatagcatgtataggattttgaagttaactgtttctgaaaacttacttgcaaatttttcaacactgcaaaaattgcttaaaataatgaagccaagaaaattaagccaggttaaaaacataaaagaagaaaaggaaggagggcaggcaggtaggcatttgttaaaagcttctttccctcagcatactattatttgcgattcagctgtcttgttgtgtttatcagtaagttgattcttggccaggcacagtggcttcacgcctataatcccagcactttgggaggcccaggtacgtggatcacttgaggtcagcagtttgagaacatcctggccaacatggtgaaaccccgtctctactaaaaatacaaaaattagctgggtgtggtggcgggcacctgtaatcccagctactctggaggctgaggcaggagaatcgcttgaacccggaggcagagcttgcagtgagccgagatctcaccacttgcacttcagcttgggcaacagagtgagactccttcaaaaaaaaagttgattctttttattgtgagtactgttccattgtataccatttgttagcccattctcttattgatggacagctgggatgtttagatgttagaaataaagatgccttgaactatcgtaagttttcatgtgaacctatgttttttaattctcttgggattagaactgctgggacagaggatcagtgaaaccttaattttttttttttctttttgagatggagtctctgtcacccaggctggagtgcagtggcgcgatctcggctcactgcaagctccgcctcccgggttcacgccattctcctgcctcagcctcccgagtagctggaactacaggcacccgcaaccacacccagctaattttttgtatttttagtagagatggggtttcactgtgttagccaggatggtctcgatctcctgacctcgtgatccacccacctcggcctcccaaagtgctgggattacaggcatgagccaccacccccggccgaaaccttaattttatgaaatgttttttatgttccagaccttaactgatgagcttttaaaactaacttctaaatttgaaatgtacatttaattgtggaatacgctttaatgtaatcttttgggataatcacctaatattttgccttgagatttttaatataaataacaataaaataaataactaatagtaaatgaataccttctcaatcttcctaaccttggaatatggggacaggatgtgaaaatatcttagagttttgagatctttacatggttctctcaaggcttttaaaaagagtatttaattgctggcagtggtagcttacgcctgtaatcccagcattttgggagaccgaggcgggtggatcacctgaggtcagaagttcaagaccagcctggtcaacatggtgaaaccccgtctctactaaatatacaaaaattagccaggcgtggtggcaggcgcctgcaatcccagctactcaggaggctgaggcagaattgcttgaacccgggaggcacaggttgcagtgagctgagattgtgccattgcgttccagcctgggcaacaagagcgaaatttcattccaaaaaaagagtatttaattgtgttgattttaatgattactgaaattttggctgtttttttgaaactatttcttgtttcctttctctttcccttgtaaataagctgtaagagaaaactgctcaatcacaaaacgtaacagaaggctttcatgtcagtgtccaataggaatgaattttttatggtgacaaggtagggttataatccagatctctggtaggcacatccataaggtgcaaggtgtgtagaaaatagcatcagtttttttggctgggtgcggtggctcacgcctgtaatcctaggattttgggaggctgaggaccgtggatcgcctgaggtgtcaagagttcgagaccagcagatatggtgttcttgttctcaaagccgaggtgggtggatcacctgaggccaggagttcaagaccagcttggcaaacatggcaaaaccccgtctctactaaaaatacaaaaattagccaggcgtggtggcaggtgcctgtagtcccagttactcgggaggctgaggcagcagaatggcgtgaacccgggaggcggagcttgcagtgagctgagatcctaccactgtacttcagcctgggcacagagtgagattccatctcaaaaaaaaaaaaaaaaaagagtctaggatccagagaagtaaactgtattaatgatgtggtcatatccatgccagagcttatttggaaatgcacagaattgattccaagatgttttaataatgcaatctggggtttgtatctcaaagtaatgatccatcaaggatggtctttagagctattttctaactcacatgcttagtggagactcacatcaaaatgccctgttaataggaatcagtagctggtaaactgaagcctaattcaattggtgtaatttccctgcaaattcgtactccatttctgtgctatcaactgaagaccacccacccaaagctattagtatacaatatgatgtgtaacagagctccatgacttctctgtggaataaattatttcactgtagtttttaaaaatatttttcatgtttatactcagagtaaatgagcaatgttacaactattcttctctgtaaattgtcacaccttaagttccttaggatggctcaactctttcacatttccagcatgggaaataattgtttaataaaaataaaacataacaatggattcatgatccaaagaaggcaaaatagaagatttcttgttttctatttctcttgactcctcagctaattgtaccaccactaaacctttctttatctcccctacctcacagggttaatctctaatgctgctcaacattttatacctatgtggaaactaccatttaactaaattttgtttgatgtggaaaaaaaatcattctttcaatatttgataattttggatagctaagcacttttgttagatttttattttcttcaagagaaataaaatagatgcagtggaaaggattacttctcagtccccaggggttgaacactcacccgaggactcagtgcatttgattcctgacacttatttaagtccccttttcatgcttacttactaggacttcttaaatttgtctccttccaggtgaaataattcaaaacaactcaagaatggaactactgattcattaataaagaacagaaaataaacaagggcaaaacttgagaacataaatacacaaaaacacaaagactcacttaatttttatctcagataaaaaaggaaagtagtttgctgaatttgcctttctactaagaagtctttgctttcacttggttgggagggtacttaacatgaagaagcaggaattcctggaaaacaggccccttctaccctaatgtgttttctgtggggtcattcagttattgtccctaagcagaggtaactgggaaatagccttgggctgtaattttcccattttaccttaagcaatatcataactagcaaagtgtgacacccaggaggtttgttttctagataacactctctttacaatataagggctctttgagagagttaatataataaatcctcagagtaaagtctaggatactctttagaaattaaatattacttgaaacatatgaaagccattcagcaggtgacagagctatttacaaatagattaaacatctttcaagtaaattattataacattcattaatgttgttagtgtttatgcactaaaacatagcccaaaataacatattttatcctcatattgtagcacaatttatgttacacttgaacaaaaatccctcaatgtgcagctgattttaaatccatcatcagttctactagtcaaaagtggagaatctttttgcatttgtacctctggtagccaaagtaatgtatcttctctccatgtttctttatccattcattaatgtgctgttttcacattgcttcgttttgaaattgtccatggcccagctgaaccaagcagaaagatttcccagtctggttgcattgtatttcaccttctgttgtcaattcctttggtctcctaagaataaaatcctttggtctcataagaataaaatgagttttgttttcctttgagcatgtagaatatttttggttattgttcaaaagtgaagccacaaatcagaaaatgtttttcttcttcgtttatttgctcctctagcaatgtatatttcatatatgtgagcgcttaggtctaaatttcaggtctacattcggcacagcatcttcatggacagctaatgagattgcagatggtaaagcagaacatgtgtggtcctgggataaactactccaaatatcttattaaacccttaaccctcccctctctcacaggcctcctttgcataaacattttatattacatttttataaagacatagatgaatacctccactgtaatttttcttaaaatttagcacgattatctcctttgaagaatagaatggtcctttaatcaaccaattaaaattgtataacccaccagaagaattcatatattatgtttaataattagtcacaaaccatatgtctgggactatttaatattgactttagctccatgtatattatttccatctacttttttattttagtaggttaatagtatgagtatgaatatattaatttctaaatggaaagagatgtactttattaagctttggattgtcaaggagagcaatggttaaatatgactaaggtccatttatatttaactctgctatttttttctggaattgacagtataggtgaatgcatgctcgtattgtactttctcctttgaaataatgaagaagccagacaaaaggattattgctcacagaagagaatagaaaaaaggaagagaaccagggaaagaaggacccaatccactttctctaaaattattcatgtttgagacaatgactgatttcatgagtatcttcttacctctctatgtctttttatggcatattttaaggttgatttttgaactgcctttataaatgttttctaaggtttcaatgaaggtaaatatgcctttgcaaactatttctcaggctatgaaccatgagtgtgtgggtcagtgagtggcaatgatgacatgccacacttgtggagaaataaatgatgaaaggttaaatgctttttgccttagatcaggaagaagaggttgttcacttgtttagaatgaactctctgagtttctttatctgctcagcttgtagccattgtttctgcagccaccagagacccagacagaagcacagcagcaggagatccacttgcatgggtcagattgcagatgtggcttcaatgacatgaccacagtgtgaaagttccctggggggcacacagcatgcttagaaaacacacacacacacacggaggtcattgcctttattgggtccagggcattatataaacagggagctttaaattgatgggcttaaagcaagcaggcactagtactaggaagtcacattgtgactgaaaagtgtttaaatggtcgtttagaggaagcagcaggaaagctgggagcccatcctgctaggagacagagatgcctccaggtttttatttctggtcaccacctggagccatttgggggtatagtgcaggaaactgcatcaagggtgactgaaccctgcttctggtttgagaaagttaaacacatatttaaaaatggatgctaaggcaacataaaactttaagcgctcactgcagcacatttacctcttttatttaccattgtattggaggttctagccaagataagataattaaacgaataataaagtaaagtcattcagattggaaaggaagaggtaaaattagctctacttgcagatgacattacctttatatagaaaaccccaacaatgccactaaaaaaaattattggaactaataaacaagttcagcctgacggcaaggtacaagatcaatatacaaaaattgtaggggcccggccctgcacagcgccctggggaagctggtttgaaagctctggagcgaccccagtgccgggtaaaggacaagatttgcccagacagaagggaacttggggagaggtggccgtaagagtgtgggatgaaaatgttttgggcagagcggtcgaactcacctgaggaaagcatggggggaggagtcattaatatgaatgagtggcagggacagggcgtccttgcagcgccctcggtgttggaagggaagaccgtgcagcgcgatggggatcagggcggcgggccgcagccggggtggggttgggcgccggtcagggtgccttgaagcagattctgtcctcaggagctgcagttcttcctcctccgccctcaccggcgggcgaccttaggcagggagtgaaatgcaacgggagccctggagggagggtgaagccgcgcgtgcaagaggaacctcctattggcgagttcaggtcccccagctgcggaggtgggggaccctgtgtggcagcctgctgagcggctgcttgctccgcggttggaggggggaagctctagcccccctcctctttttcagccgagaaaccgctagttacccccttatgcaaccaagactgtaataaccctgtcacctttcacggccctccgggtctgcgcctatcctctgaagattcactcatccaccccgaggcctgttttcctcacctgttgtccctctggcagaacctaggcccctcggagaccagccagaatctatctgcccgctgttcccacccaccacactccctccccagttctatcccagctccttaaactgttggagttcaaacctcagaccatgacagcacacaggcctggactccggtatggccctggacaagttccttaatctctctgagcctcagctttcttccacgtgaagcagcggtaacattgttattaggagcctcccggccccagcacaccgacatacatacaactggatatccatcctgcctgtgaggagtcgtctttactttgggttgtttcttgtccacagaggtccacactttattttcctggaggcaccagcggagtcactgatgcacccctgcatccagcatgtttaagggagacagcctggggagggcaggaagagcctagagggtcccctagtgattagggctgtgatggggatgttactggaaaagggtccctatccagaccctaagagagggttcttggacctcctgcaagaaggaatttggggcaagtccataaagtgaaagcaagcttattaagaaaataaaggaatgaaagaatggttactccataggcagagcagcggcatgagctgctcgactgactatacttacagttatttcttgatcatatgctaaacaaagcgtggattattcatgagttttccgggaaaggggtgggcaattcctgcaactgagggttcctaccctttttagaccctatagggtaacttcctgatgttgccatggcatttgtagactgtcctggcactggcaggagtgtcatttagcatggaaatacattataattagcatataatgagcagtgaggatgaccagaggtcactttcgtcaccatcttggttttggctggctcctttactgcatcctgttttatcagcaaggtctttgtgacctgtatcttgtgcggactttctatctcatcctgacttagaatgcctaagctagtgggaatgcagcctcacaggtctcagccttattttacccagcccctattcaagatggaatcactctggttcgatcacctctgacaggggcagtgtacattcacatcttggcctttgctgcctcatccttccagatctttcagatgcttgccctctggcattctaggataggaagactgcttccaaagtgacgcaggatttttctcggacacttttccaactgcagacttctggctgacgatgcccctgcccatgcctagctctgccccaggcaggaggtgccctgcccacttgggcttgcactctggtggggatcctgcagccaccgagactgcatgctcagccccagtaggagggggtgtgtgatcaagtgagtgcctcatcttgccagcaactccaagtgctggcgcaggagcgggctccctttggggcctgcagctggatcaggcctgtcggaagtgactccgggggtgaactctggcatgcagatgaagggaacttggtggcacccaaacaggaaagcactcgactctgaagccccagaggggatgttacagccatgctaacagctcttttagtcccaccgtcagcagcctgacaaacgggcatgttaacaatgaatggggggtgtgttaacaactctgtcagtcctgttgcctgctcctgctggaggctccctggctggcctggccctgcactgcctctcatggcaaggggctgccactgggcacaggtagtgggggaggggtggagggctatggtgttactgccttcttcgtaccctttgctgacaatggaagggtgaaaagggcagagaagagttttatgaagcaatgaaacagctctcagcggagaggggatgcgagggtggtccctgacctgaagtcgggtggtctctctctcagcgtggctgggtccggggcttttatgggctcagaagtggggactgcatgctgattggtttacgagtatacaaaaaaggctaaaacaaaggaaccattcaaaggtggcatgacagtgtagaaaaccacctagggaagggtagatatatgtaaagtaagtgaagggtggggatcagtcagaggaaagtgcaccaacaggaagagatgttctcagctcagtccatggatttatccaagacttgtagcttagctttcgggctttaaactgccttcggtttgaaagttggatttcgttggggacatgccactatctgcctaggggcttgtctgactcctgccactattaaaagtactaaatcagtgcatctagcctgagggctgcccctcgtccacccagcagaggtttttgttttgttttgtttttcttttgttttaattaaaattttaattaaaagggactaatatagagggtttttaaaaaattaccatatgtgttgagtatttatgctatgccaagcactttgcatatattttctcatttaatcctctaaatagcgaggttgattgccttatctccatcctatagatgagaaagctgagactgagagaaacccacatgaggtcatgttgtatgtaagttagtttttgctgcatcataaaccacccgtttatgatttcaaacaggtaatacttgtttctcaataactggatgggggctggatggctaaggggcctcatattttagggacaggaggagctcatcgtcagctgggtgatgggaatgtgaccacaagtctcattatccaggagagcttgaacataggggttgagtttcaaaagcagcataagggcagcaacacaagaacttcccatgtctcacttatgtcatatttgctattctcccattggccaaagcaggtcacaagggcatggccagccggtatggaaggggacaaccaaaggggtagacacagggagtgagaattgctgccattttccccaacaaagaatctaccatccatagcttctaagtgtacagctggaaatcaaaactaagtttgtcttacttgaaagttcaaaactgtcttggagctactgcccggggtctaggaatccagaacattccacacattgcctaagtcaacaacctgttgcgcacacacaccagcaactgttttacaaaagtatgtggatctggttgtcattgataaaatgcaaattaatttagatgtattattcaattcatagtataattttgttgtattttcaaatcaacagatatttacatcatttcaaagcagctcttcacaaattattcattagttacaaaaggaagtcacttcacagtggaaaaatctggcaggcgccaccttaatcaagtaaccaaaatgaacatcctcagtaataggacaaattgcaatcgtgtgcctcctgatagtctagcaagaagaacacagcatcacttctatgatgctcctgccaataatacataattggaatctaatcctaaagcaacaaattcaaattaaggaaaattctacaaaataattggcctgtaatagaagtgtaaagtcatgaaagttaaggaaagactgaagaactgttccagactgaagatgaaagagacgtgagaaataagtgcagtggtgattctgaactggatcctgacttggcaaaacttgaatagatctgttggttggatggtagaaatctattaatgttgatttcctgattttgctagctatattacaattttattgcattcagtccttgtttatagaagacatacagtatgtaggggttatagggagtcaggtcaggaactttcaaatcatttagcaaaacaaaagttctttgtactttaattccaagacttctataaatttgagattattttaaaaatacttaaaaaaaaactcctttaaagtctctcaacatgctgtcctattaataatagatttctaaatttgtttttatttttatcaaggttttgtgtgcccatagtttgaagtattaaatctttttttatttattaaaatattttttaatgtccattcagaggtaatgaagtgttaggttttttttttttgttttttttttttttttttttttttgagacagagtctcgctctgtcacccaggctggaatgcaatggtgcaatctcggttcactgcatcctctgtctcccaggttcaagcaattctcctgcctcagccacccgagtagctgtgattacaggcgcccgccattgtgcccagctaatttttgtatttttagtagagacagggtttcaccatgttagtcaggctggtctcgaacccctgacctcaggtgatccacccgctttggcctcccaaagtgctgggattacaggtgtgagccactttgcctggcttgaagtgttagttttatcttttttttttaaagaaaagtagttcccttatctccactttccccctttcctgcacctcagaggcaactgctttcagctgattactttgacaggtatgaccttatttccacgtaattgcttatgtcattatttttttctttttgaggtagggtcttgctctgttgcccaggagtgcagtggcgcacttgtagctcactacaaccttgaactcctgggctcaaatgatcctctggcctcagtctcctgataagctgggactacaggtacatgctaccatgcctggctaatttattttcgcagagacaaggtctcactatgttgcttgggctgacctctaacttctaggctcaagtgatcctcccgcctcggcctcccaaagtgttggaatacaggtgttgaaatcaagtttagcctaaagccgcctccttatatatttaagtttggcctaaaagtttgtctgtatattgtgacaagtggaggtgtaaacagactacacttgtgccaatcactgagttttggccaatcaaatgtagccaactgttcaaaccatgttcagataaggcaaatgccaagctgcagccaaacccagctgtttctgtacctcacttccattttctgtccataaaccttccaccgcatgactgtgctggagtgtccgagcctactctgcctgggaaggctgcccgattcttgaactgtttgttgctcaattaaactcctttaaattaaaaaaaaaattgtatttctctactctagcaatgaacacttcaaattaagacaattccattgataattgcatcaaaaaagaaaatgcttagaaattaattattcaaaaagagcaaaagttataccctaaaactacaaaacatacttgaaagaaggtaaaaaaaaaaaggagtaaataaatgacaagacaccaatgttcagagattgggagacattattaagatggctttccaaattgatatacagtcaccatgtctctatagaaatcccaacagccttttctgtggaaattgacaagcccatccaaaaattcatgtggaaatgcaagggactcctgatagtcaaagtaatctcaaaagtgaagagcaaatatggagtatgcacacttctctatttcaaaatttactacaaagctatagtaataattacagacttgtactggcataaggatacacatatagaccaatgggatacagctaagagtctagaaatcaatgtttacattaatagttgattttcaaccagaatgccaaggctgttcaatggaaataatagtcttttcaacaaatggtgttgggaaaactggatgtcacatgctaacgactgaaactggaccctttcttcatattttatacaaaaagttacctcaaaaatatatactaaaatttaatagataaaattataaaactcttagaagagagcataggggaaaaaaatcttcttgactttagctttcttagatatgacaccaaaagcacaagcaacaaaagaagaaaatagataagttggacttcctataatttatacatatatgaatatatcacattgtatcccataaatacacacagtcattatttgtcaattgaatttttttttaaagaaaaaaaaaattttttttgaggtggagtcttactctgtcacccgggctagagtgcagtggtgtgatcttggctctctgcaatctctgcctcctgggttcaagcaattctcatgcctcagcctccccagtagctgggattacaggtatgcgccaccacaccaggttaatttttgtatttttagtagagacggggtttcgccatgttggccaggcttgtcttgaacccctgacatcaggtgatctgcccacctcggcctccctaaatgctaggattacaggcctcagccactgtgcctggccagaatttttgtagttccaaagatgctaccaagaaactgaaaagacgacacacagaatgagagaaaatatttgcaaatcatatatctgataagatattatatccagaatgtataaagaacacttaccactcaataataaaaagacaaataacctagtttaaaaatgagcaataaatgtgactaaagatttttccaaagattggcctgtgtgctcataggaagatgatcaacattatttgtcattagaacaatataaatcaaaaccacaaaaaaggctgggcatggtggctcacacctgtaatcccagcactttgggaggctgagatgggcagatcacttgaggtcaggagttcgagacaagtctggccaacatggcaaaaccctgtctctactaaaaatactagctaaaaattagctagctaaaaaattagctagctaaaaattagctaggcatggtggtaggtgcctgtaatcccaggtacttgggaggctgaattttacttttagatggataaaatgtacattatataaactatatgtcaatacagctatgtatttttttaaagtacaaactatttttttaaatacaaaaacattacatagcgtgaactccatggcacagctgccatactgaaggaattatactgtgtttaaaaacctgattaaaaattaagtttttaaaaaatggggtcattaaattttattttaaggttttaacagttctttacccaagccaaacattttatctacagttgcccaaggaaatgcagtaagcgggttacttaatttcctccctgtggcaatccttggctctcgcccttcttaacactttattaatgcaagtcagcaactgctagttttacatcttatctttcatcaatgtttaagagatagcaagtctagggctcattatgatctgctaatatagttcttaacaagacacttagcttccatagttatttgccaatgaagcaagaaagtggtaccacttcatcattattctgattttattggagagagtgaatgtgtgagtttactgagggaagcagcccaaggaagtgggatgggacaaattctacaacagagatcacccatagacaaggagtggacccatgaaacttaaagacgtagcgatttagggagtgactttacatcctaggattaatgtctttgggggtttatgattaatatttagttccttgttgccatgtaacagaagatgtaaatgggttgctgtggtgagtcatattataattttggttttttttttttgagacggagtcttgctctgtctcctatgctaaagtgcagcggcgtgattttggctcactgcaacctccgcctccctggttcaagtgattctcttgcctcagcctcccgagtagctgggactacaggtgcccaccaccacgcccagctaatttttgtatttttggtagagacagggtttcaccatattggccaggctggtcttgaactcctgacctcgtgatctgcccgcctcggcctcccaaagtgccgggattacaggcgtgagtcaccgcgcccagccaattttggttttaattagaaactagataggatgcataccaaatatatattatgacgtgtccccaccccctgccaaatagacacatatacattgtctccttatcttttctccaatcacagtatctatttcactcacaacttttatgcaaaatcatgaaataaaaataattttaaaaattattaatcttcaaaatcttaaaaattattaatcaaatggataaatttgatatatgtgatattatttgtctttggtaattttgtaaagacttttaaactgtttttaacattcaaaaggaaagacacatctctctcttttaatgtagaaagacagtcttggttatttacagcatacatagggggccttatctgattctccaatccctggaaaaatagagttgaatgctcatttgatcctattccacatgctactggtttccctcctgttcaccctgctccagccttgaggatgttcttgttgaaatatcaccatccaaagctcttcctctatcaggcttttgcatttgctgttcccttttccacatcttctcaaggctggatcttctttagttttcagcaaaatgtgaactctgtgaagaggcctccctgaccactcaattagccactgccccatgactagttttttttttttttaactttcttaaagtgctttaacttcctcaagcccttattattattctttgagtgcattttgattatttgtttcttgtttatcatctagaagtagatgacaacttcatgacaacaggaacataatcctcatgagggcaggcattttactagtattgttcacgattactctcccactcccatgtcaaattctgtgctgtaataggcattcaataaataatggaatgaatgaacgacagacaaatgtcacacatcatgccacctgatgttataacatccaatgttgataaccaaacagaagcaaaattaaaggccatgagatattggaatggtcacactgattaaaggctttgtgggctacacctcattgcacacatttatcaatgactgaattaaggtgatatttagcagtttgatattacctatgaaaacaaaccaaatggatgtagcatgctttctttttttgaaacatatttaataattgatttcaatcattttcaatctgaattttaatatacttttaacaacagatttcatagtttggtcttgtttttcttgtttgtttagtgactcgtttacttgagcattaatattaagccagttctttgtgtagttatatgtagaagtagccatcaactcccaagcaccaactccaggccagttcaaatacggaagactcacttgaattcctgcatctcaatgatggtacagcctggagcccttctgtcctccataccaacaggcatttacagctgatttggttgtttggcagcgaatctctgtcctgctgccttcaagctgccatttcatttcttcaatatggagacaggaaatgtggcttaccatcagcaacaagctagtagtaatcatcctcatggaagacacaaaaacgtttgtcaagagggtccaaagtttgtagctggtgagaatgtacaggaaagaaggaaggaaggaagagagggagggagggtggaagagacagagggagggtggaagaaagggaggaaggaaggaaagagggagggagtaagagagtaagagagagagcctgagaaagatagaggtggactccacacataccagcaaaacaaactcatgaggtagaactttttagcatttaagctttgaccagcatccagatgattttcttttcttttctttttttttttttgagacacagtcttgggccatctcccaggctggagtgcaatggcacgatcttggctcactgcaaccccctcctcctgggttcaagcgattctcctgcctcagcctcccaagtagctgggattacaggtgcctgccaccaagcctggccaccacgccatcacttctccatgttggccagcctggtctcgaactcctgacctcagtttatccaccctcctcagccttccaaagtgctgggattacaggcgtgagccaccgcacccggcctcaaatgattttcaaatgtactcagcaatgcaaaactatcatcccgaattcttaatttggtgcattttgcttaaaggaatgtaagttgacaaatggtatgtgtaatttcccctgtggtttccctcttcagagtctgtgctccctgcattgaataatgagatgtaagtttaggaaatgcctccatggtgttcattatactttgtgtattttccctgagacaggaaacagaggactgtctgtcaaagaaagtaatttttataaattcacagccaacggggaatattcctttcattttttttagctaaatctgtgatttaacaaatgtagtgtttgtcagcaaggagattgaaaccattatgtctttctctacctgttgataatgatattgcaagtgggaagtcgcaaatatattggcatcaatagcaacacggcaagcagatgaagctccaaaactcatcacccactttgaagccaaataaaaagcccatttttctttctagttattaatgatgtgaaactacagactgtaactgcaaataatcattggcaagggcaacataaaagttataaatttaggctttgaaaacgaatcaaacttgaaggaatcctctgtaatttattcctaaattaaagatttcctctttttttttttgagtgaaagaacttatacgtaagcatggaaatgagaactaaatcatttgctgaaacaattgtctgagagttacttaattcaaaaccactcttgtctatgaaataaagcagaacttgattagcacgtaataaaaggcaattaatttaacagacagtaaatatattgctgattcctgaagtctctggccccattttctcttcagaaaactatttcaactgatagcattctctcctttcattgaagtcctatagtaattaaaatcagttatttaattatatactgccttgatatacagagttcagactttgtaggactattgctaatcatctaaatcaggagtttggtaaactatggcccaaagaattaaacttggccataaccatttttttttctttttttttttttgagatggagtcttgctctgttgcccaggctggagtgcagtggcgctatctgggctcactgcaagctccgcctcccaggttcacaccattctcctgcctcagcctccagagtagctgagactacaggcgcccgccaccacgcctggctaattcttttgtatttttagcagagacagtgtttcaccatgttagccaggatggtctcgatctcctgacctcgtgatccacccaccctggcctcccaaagtgctgggattacaggcgtgagccactgctcccggcccttggccatacccatttttttacattttatctatgattgctttcctgtgattgagttgaacagctgtacagagacattacagcctctagaacaaaagtaaatttactatctggccctttgttgaaatagaccttaagattgtcacgggaaaaaattgaatctcctactcagaggatattgtttcacaagtgcggtccctaaaatggagcagggaaccctcttggggcctgcaccccctccattccaccaccctgcacccccatgcatggaaataaaggaaaatattgagttccttcaagggaaattccaggcacctagctaaccctgagaagcaagcaacttgataagcaagaaagtaatcacagcttaaaacaacagccaaggaagttctagccataagatatttgaaactaaaggcaacattttaacatatgtccctgagttgtttttcagaaacccagactccctaccgagcagatccgctggcgggtagaacacagataagggggagctgaggactgaaccccgaactccgtttgtccttggctctaaatttattcttgagggacctggaggaagccgtgcccacgtgccagagctaataatcttttctgctgaccccaaatgtttaaacaaactcttttttcatcaattgcaaaacagtctttgaatataccaatgaccggtaatcttctacttcaaactatcccacctttttaggccaaaccaatgtatcagttcacaattttgttgtaacttctgttttcctgaaatttacctctgcctttaaaacccttacttgtggccgggcgcagtggctgacgcctgtaatcccagcactttgggaggccgaggtgggcggatcacgaggtcagaagatcgagaccatcctggctaacacggtgaaacctcgtctctactaaaaatacaaaaaattagctgggcgtggtggcgggcgcctgtagtcccagctactcgggaggctgaggcaggagaatggcgtgaacccgggaggcggagcttacagtgagcggagatcgcgccactgcactccagcctgggtggcagagccagactccatctcaaacaaaacaaaacaaaacaaactcttactcgcaagccatcaggaggtcaggtgtaaagcaggagctgctatattctccttgcttggcaccctgcaaataaacacctcttttctcctgctgcaaaccttggtgtgggtgtttggcctgactgcgctgggcaggcagacccagcttaggagtgaaaacatcccagaccagcagcatgagcaccacctagcaagttgtcagaaatataaattccaggctgggcagagtggctcacacctgtaatcctagcactttgggaggccgaagctggtggatcacctgaggtcaggaagtcaagaccagcctggccaacatgatgaaaccccgtctctgctaaaaaaatacaaaaattagccagggtggtggcgggctcctgtaatcccagctacaagggagactgaggcaggagaatcgcttcaacccaggaggtggaggttgcagtgagcccctgagatcatgccattgtgctgcagcttcagcaacaagagcgaaattttgtctcaaaaaaaaaagaaaaaaagaaaaaaagaagactgaccatgttgagaggtgaagccagctgggcttctggggcaggtggggacttggagaacttttatgtctagctaaaggattgcaaatgcaccaatcagcactctgtaaaatggaccaatcagcaggatgtgggcagggccaaataagggactaaaagctggccacccaagctagcgtcagcaactcgcttgggtttccatccaggctgtggaagctttgttcttttgctccccacagtaaatcttgctgctgctcactctttgggtccgccccacctttaagagctgtagcactcgccacgaaagtctgtggcttcactcctgaagtccgtgagatcacgagcccatgggaaggaggaaactcctgacacaccatctttaagggctgtaacactcacggcgaggttggctgcttcattcttgaagtcagcaagacgaagaacccaccacaaggaataaattccggacacaatgttacctgtcatttaaaatgtagccacttctcctccctttcctggtctctccttgttcctattggaagttacctctaacacttccatttgtttaatatcataaagttgcaagaaacgtacagagagagaaaaaggttctaacttttcttaagataatatgggtgtatatatacgcaaatatatatataatgcttgtataaattaacatttattatcttctatgatatgataaggcatatcaccaagtaatctggaatatcaaaatatcagcatcagctctctctgtttcaatacgtataaactaggtagttcactaggaactttgaatacattagctctgacctttacaacagttctatggaaaaaaaatagttatctccttttaacagaggaagaaaattgatttttcagggtatttccactcttacctcagtttcctcatatgtaatgtgggattgactcagtcatctgcttgaaagaagacgggcaaatctggtcctctgaagagggaaaggggagatgagtgaaaatgaacagaggaagccaaaaaaaaaaaaaaaacacacacaagcacacaccaaaaataaagaggagacccattttaacaggcatataacaagtcagttttatctctttatttttttattttgtatttttttttgagactgagtctcaccctgtcgcccaggctggagtgcagtggcacaatcttggctcactgcaacctccacctcccgggcttaaaggattcccttgactcagcctccagagtagctgggattacaagtgtgcaccaccatgcctggctaagtttttgtatttttagtagaaagggagtttcactgtgttagccaagatggtctcgatctcctgacctcgtgacccacccacctcggcctcccaaagttctgggattacaggcatgagtcaccacccccggccgaaaccttaattttatgaaatgttttttatgttccagaccttaactgatgagcttttaaaactaacttctaaatttgaaatgtatatttaattatggaatacgctttaatgtaatcttttgggataatcacctaatattttgccttggcattaggcatggagcatttgtctgggtgatcacatggagggccctgcctcagtttacctccctcattgacctgcttgttgactaaattatcataacttgatcacaattcctttgaagctgcctgaatcaaagccactgatctgcagataaaatcaaaatacacattcagtgttacacacaaagtaacattgccttatatactgtatctacactttattgagaactggaaattccataaagatggagaggcattactgaaggcaagcaagcaaaactctagcatgcagtcagactcatggcaggaattaggcatgatctaccttgtcctcacccttggggcactgcctgcatgtctgtaggcctcggccatgcccagctcctgtggctgcctggaaagtgtgggtttggccagttgctgccatcactactcctcaataggtcctggatctcagaatttgcctggtagtcctgggcccacctgctgatgttcaggataaagggagtggggagaaggggtcattctgcttccttcacgtggaagtgcaggtgttagttttgggggactggacagcaaagagcatggttccttgactcctgggtcatggggtgtctggccacttccacatcgttgccactcactcctagtgatacaccaggcaccagaggctccactcctgaggcacatgccccggctgcctcaacactggcccttccccccaccttggatgagctcctgttgcttcagcatgagcagggctcactctttcactctgcagcaggcctaggctgtgctggcttctgagatgccccggggcacctgctgggaagtggggtgtatgtgcgtgaggcgccagtgttggtccattctcgctgggcagccttattttcccagctttttccttgtgccgccctcagccttttgtctctcatgacttccctttcaggtcacaccactttgctgcttgacccttgagtgttagcaacccttccctgctctgggactcagtttaccttttgttggtctagaggggcaggacaggtgatttcttcccagcttgactccagatcaatagcttgccctcccctggtgacagcagagagatctgtgaatcactgcccaccctcacccccactcctgcccctcggcatactccccgccccaggtcttcccaggtcacctgctcttaggctccaccacacccctgcaggtcagcctctcccagcagccttcccgtagactccttctcctctctccccctctctttcctgtagaggctttggagcccatcagcccgaggaccaggactccaccgccctgcacccctcttgcgccaggatggccccaaacttcggcagatgctctggctctaaaacttggaccagcaccaggtaccccaggcagggccctagttctgctgtcctgccctgaaggccatgttcggtggctggcctagcctgatgggaacatgtacagtcaggaaatctctccacagctccaggcccaggtaaatggttctcaatactctggtccaagggactggtcctttgaggtcaggagcacatctcagcttcaaggaaagctgaaaaacatgcaagactctattgccaggagaatttatttttattttttctttgtgttattattattttttctttatctgccttttttttcttttttttgttttgtgatggagcccaggcgggagtgcaggggcatgatcttggctcactgcaacctccgcctcctgggttcaagtgattctcttgcctcagcctccccaggtagctgagactacaggcgtgtgccaccaagcccaattaatttttttttctttttttttttttagcaaagatggggtttcaccatgttggccaggctggtctcaaactcttgacctcaggtgacctgcctgccttggcctcccaaagtgctgggattacaggtgtgagccacctcacctggccctgggccaataattttttaataactcctaccataatatttttgtttgttatttatttgataaatatgatagactaaaaataaattagcaaggccgggtgcggtggctcacgcctgtaatcccagcactttgggaggccaaggcaggcagatcacctgaggtcaggagtttgagaccagcttggccaacagggtactaaaaatacaaaaattagccaggcgtggtggcaggtgcctgtaatcccggctacttgggaagctgaggcaggggaatcacttgaacccgggaggcggttctgtttgcaagtatagttgtaactgcaacccaaaatgtcttagaaacttgctatttgaagtattgtcatcacctgggatcttgctagaatctgcatttaacaacattctcaggcaattttaatgatcattaggtttgaaaaacactgccttaaaacaaaggaaagaatggcaggcaagtttcaattctaagcatgctatattgtatgttcttgggcaaattccactaagtctgaattttaaaacagttaactatgggtagtaatgaatgaagtgtcaccttgtaaagctactttgagaaatccaagtgttggcaaaccctttgcaaaaataaagttgctgaacatattctaatacagttatgttgggctcctgttcttatgaggcagagaaaattatgctttaatcagagcttctaagtcacaatcactggaatctattattagcctttaagtcctcattcttgagacagcaccatgtctattcttggttgctgggaaactgattatgctcttcaaatagaaactgcagcagcagatgaactttaagaaaatataatcatgtttgtaagaagaaaaatttaataaaggaagaaatgaagcaaaggaaactcataaactgatctgttttgaaattccatttctgccctcatgatagcattattgacttaataatgaagcaatgttactcattcacaattgtacagcaatggccaaagactgaatgacctctattttctgaaattgtttcattcacagagttcactcctgatgggaacatccagagacatcttcagagagctttgctttgacccccaccccccaacattttaaggcatggatctggaaataatgtagttggtttacaaaggtaagtcttattttacaattgcatattccacaaaggcatttcactttcaaagctcctccaagacaattacctccagattgagacacaccctgctcctgaattcatgcctgcataccagccattcttaatcaccttcctttttaatccagttggaaaataaaatgtttccttgttctctgaatgtacagtactcagatgtacagtgaaaatgattgatgctcaaaccgcctataaattctttgattccatcagcttttctctttctactggccatttcccattagtgtttaaacttaagactcacacatctcccatcaaataaacccccttcaccctacttcaccgatttcagtattttagcttctcctctccttatttacttcccatttgtctttcagtccatcctgctctattttcacttctacaattgcacagaaatgtctctgataaaagttcccagcatacattttggaactgatattacttgatctcacttcatggtaacaatatgctgctgatggaagtaccacagaactcacaaaaagcttttacttctccaggaaatttcatcatgtctgtctagacccaacaaagccaaaccctgaacaatggccatttcagcctccatttgacccaagccaacttatattgaataaactaatgctttaaaaattataatgagccaggcatggtggctcatgcctgtaatcccagcattttaggaggccgaggcgggtggatctctagaggtcaggagttcaagaccagcctggccaacatggtgaaactgtatctctactaaaaatacaaaaattagctgggcgtggtggcacccacctgtaatcccagctagtcgagaggctgaggtgggaaaatcgcttgaacccgggaggcagaggttgcagtgagctgagatcacaccactgcactccagtctgagtgacagagcaagactgtctccaaaaataataataaataaataatgaaattcaattgataatgatggaaatcaaccaataaacctacaatactttaagattctttttaaaagaaaacaatatatttttattagaaaaagtaaaggatttattcataataagtaaatcttggtttcagagctcttaatttactgattgactgtgatcagatgccagtgggaatgtgtctgtagcaccattactcacatgagggagtattttaaccctttatatatacatcactaatagtggaaccttgaagaagtccatttctcaatattgatataaattataatttatattgacacactagttttttttcccataagttttatattgaatccaagaaagctttatcagtgtctgacaccaagaaatatgctttaaccgtaatgtatttggaatgtccacagtatattccacggtgtgtgaatctttagctttagaaattagctttgacaagggagaggtcctgaattatccaacaacaaaattgaattattgtataagatgtagcgcccatacctgcagggcatgtgaagctcagtgattggataataagacttttactaatgttatggaacctgggataagcattgcgatagaaccaggaagactgttgtagttcttttatgactcagaaacagtatgatgacttacaactaaaactttgttcatacaaggccagcactcttctaatgatgcaatatgcatttgatttatccattgttactattgtccacatgaaaagcaaaaattgacataatgtttatgatttaaataatgtaatatataattataatagtaataaaagcatatataataacgtttatattatgattacgttaggtggggtttccttcttttcccttcaaagctggataaaattgaattatatagccaataacatgccctgtgcaagtctaatactctcttgaaaagtgaaatctctcaggtaagccaaagtttcattgtcacctctggctaaaaatttctacttctagtacgtgtgagatttttttttttttttttttttttgagactgagtcttgctctatcacccaggctggagtgcagtggcatgatctcggctcactgcaacctccacctcccgggttcaagcgatttttgtgcttcagcctcccaagtagctgggattatgggcgccagctaccatgcccagctaatttttgtatttttagtagagatggggtttcaccatgttggccaggctggtctcaaactcctgacctcaagtgatctgccccactcccccaccgaaaatgctgggattacaggtgtgagtcaccgtgcctggctgaggattccttttttaaaagtttctacagtgttggaaaataatcaggagagtcaggcaatgtgaaggaactactcagatgtcactggccatctggttaagaagcacagtgatgccatcttgttctaggatggcggcagtagggatggagagaacgttgaggagccattctaattcttcccattaccgtgttttatttttgtaatagcaatgatcactttctgcaattatattatttctgtgtatgtttgggtattttttatttatctactttattttcatcttccaccatgaaaatataagatcgaaatggcagagtaaagatgtgctttgtcttgtacactatatcaacagaactttgacattgctgacagacagttgatgcacattaaatatttgatgaataagtggatgaattaatgaatggaaatagagcaatagggttcgctctagggtagtgtggtatcatgcaagtgggtgtgtaaattgggagagacctgagcatgtttaaatatactggggaattatgtggttggaacaataaattaaatattgagatactcaagcaagatgtcatgggacctaatacaggagataagactatgtgattcgcattaaacactcatgtagcatgtttatacgagatcttcagacttgctatataattattcagcactcaaggtggtgcttaggaaaattgaggaactaaagactcctttgtgttacctgatctgtagaaataatttaaaaccttgtctagttttctttttttttctcctgtcataagcttgttaagagattcctccatagaaactttttttggtaaaataataactgctgttcagtgcatcatttctaacaatgtgatgttagctacaaatatttaggtagcacatcccttcaaaataggcgcttgtggcctgggcgcagtggctcacgcctgcaatcccagcactttgggaggccgaggcaggcggatcacaaggtcaggagatggagaccatcctggctaacacggtgaaaccccgtctctactaaaaatacaaaaaatttgccgggcggggtgtcgggcgggcgcctgtagtcccagctactccggaggctgaggcaggagaatggcgtgaacccaggaggcggagcttgcagtgaaccgagattgcgccactgcactccagcctgggggacagagcgagactccgactcaacaacaacaacaacaaaaaataggtgcttgcgataacttggagtgctgttcttactgatgctttcactttggtagctcacctctcctacgggaactgtgttctcagacatgtcatggggagtatgtcatcagcacagcttcattggtagagtttactaaaaatacaagttatctgtattttccttataaaggccttcgtatagcgtccaatattttctaaccagatgtacagtgaaaatgattgatgcttaaatacattttcatggtcaatgcaacaaccgttgagcaaaaaaattaacatttattgcagacactaggcagttgtcaaacaatattaatgtcattaaatcaataaatgggcacagaataatggaagcaaggtcatggatgaacagatggcagtgtaatggagtcaatcttttactgatttaaccactctcctcttatttctaatgtcccttccatcacgatgagttctctttgggatgatgtgtatctaactgaagctcctcctcaacagctgctgagaattgagtgttggtggtaattatccatatgatttttaatcagacacttttcacagattcaagtggaatgataactctatgggaaattgataggacagccagagttatgcaaattttggaaaaaaaattaatcaacagctaatacaaatattatgtctaaaggctaacaactggatgatcataataactcaatggctaataaataaactagggaaatccaagccagaattagaagtaaaaattggccattatataattatgaccaagaagttctttcttagttagcaaggggtacagctgtatgtttatttcaaagtaatttttttgtctgcagttacaatgttgaatgaaaggctaaaacaattccttccttagccctttccctttgatgtgaaaaattaactctcagtaccctcagtaactttgaatatgctttttatacccttaaagacaaaaataaagtcatcattttttcattgactgtaactattaatactatattcatgttactgtagctttaactgatgactcatttttagaacatattatcattgatctatggcaaatgcttttaaaattcctcagaagctaatcatttatgttgaaaactcacaaaactgcacataatataatagataaagggagggcataatgaagttttcatttgacttatctgggttttgggatttacccccttacagtatgtgagcctatgaataagtaggtgagcttccagtgctcaaaggtttaatgtacagtgtatttatttttaatctttgtgaattttctatagagcagagctgtttccagtgaattaaaccatatttacttctactacaatattgtagaatgtaattgttacctttactatatatatatattttttcttttttatttatttatttatttatttatttatttatttatttattttgaaaatgaatcttgctcggtcacccaggctagagtgcagtggtgtgatctcggctcactgcaaactccacctcccgggttcaagcaattctcctgcctcagcctccaagtagctgagattacaggcacatgcaaccatgccaactaattttgtatttttagtagagatggggtttcgtcatgttggccaggctggtatcaaactcttgacctcaggtgatccacctgcttcggcctcccaaagtgctgggattacagacatgagccacctcacctggccccctttactatatttaaagatgacattgtcatgtgatgtgtatgatgaaaagtatatcattgaactctattctcatatgaaagaacatctgattttctagaagatttatctgccccaggtatattcctgtgagaataatacaaaccaaattaaaatgaagtctgcttttttttttctattccttattgagattgaattcagaattccaaacaggtttgctattcattttcatcttgacaaaatcaaaacctaaatattctatgtgtcacctactgtgatgggaaagataaaactaattatttaattatcaaacatgagtaggtgaattatttttattaatcaacattacataaacgtgttttgagaataaaattttttatcctcattttttaaccaaagacataaaatataactgacattctgtagccaaatcaatgatatatacacccagattgacctttaagagtttaaaaataaatgtacgctgcatggtcaaatggatttggagatacataggctagtagatgaagcactagggctttatgaaaccttttttgagggccggtgctgtggctcaagcctataatcccagcagtttgggaggcccaagcaggcagaccacttgaggtgagaagttcgagactagcttggccaacgtggcaaaacatctttactaaaaatacaaaattagccaggcatggtggtgcacacctgtcatcccagctatttgggaggctgaggcatgagaatcacttgaacacgggaagtggagactgcagtcagctgagattgtgccactgcactgcagcctgggcaacagagtgatactccacctcaaaaaaaaaaaaaagaaggttttttttttgagttagtgatacacgttaataaattaatccagagatttaaaaaccacttttactttccatgttaaaaaaaatcagcatactttccaactataacctaaaaatctacaaaaaactttccaaattctcagtaaaggaagtattgcaatccacaggagattattgctttgttctaaagacagttgaaacattttcgaatctctgacattttttagatcaccctttgcagggtggggttcacagaacattttttttcctgatcatatgacattgcctacataattttgtgattaaatgactttggaaaatcaggattgagacaagtaaacagtcctatcagaactaaatatgttaatgtatggcgtccccaaggggtgtgatatgcagcattaactcttaaatgtagataatcatgggactttaataagcagatacactttgtgaattactactttaaatattggtagtaatagattgcttaatcgaacttaaatttaaagagatgatgttggacttctagtgaatggaagccaagtatttctatttactagaaaaatgtacatgatctattatccacagtgaactagcaaaccttccatcttgatatttagttttcatattaattgtattatatttcatcagcttacattttttactcactagggcatacttttatttttttcattgcaatagcttattcaatatctgcctattcatatattaagtaataattttttttaacctgcatctcacacagagaaatcatgaggaaatctccactcattctggtcagcatcacagttgcagtatgttgcaggattcctgggagtcgatatgattttttctaatacacacatatgtttctcagcattgggcaaataacctctccggtaactgtgcgcttttctggttcttcccacctaccagctcaacagggtatcatctgaaaaaagaatatgagaaaggcgagtcctatttaacccaactactcaccccctaatgcggttccgcttccgctcagataatgacgtaaaaacagttttttggtgtgtgtgggttttttttttttttgtttgtttgtttgtttgtttgggacagagtcttgctctgttgcccaggctggagtgcagtggcgtgatctcggctcactgcaagctctgcctcccgggttcacgccattctcctgcctcagcctcctcaagtagctgggactacgggcacccgccaccacgcccggctagttttttgtatttttagtagagacggggtttcaccgtgttcgccaggatggtctcgatctcctgaccttgtgatctgcccgcctcggcctcccaaagtgctgggattacaggtgcgagccactgcacctggccaaaagaaacagttttaagaaaataagtccaaaccctgcaacagaacatttctttaagaatactaaccagctttttttttttttaattaaaaaatatttacggctgggcgcggtggctcatgcctgtaataccagcactttgggaggctgaggcgggcagatcacgaggtcaggagatcaagaccatcctggccaacacggtgaaaccccgtctttactaaaaatacaaaaaaattagccgggcgtggtcgtgggctcatgtagtcccagttcacaggaggctgaggcaggagaatggtgtgaactcgggaggcggagcttacagtgaaacgagatggcgccactgcactccagcctgggggacagagcgagactctgtctcaaaaaaagataaaataaaataaagagactttaatatgttcagtaattacacaaaattaattatcttgagcaggccagttacataatttcttttgtttttgttttctctttctttctttctttctttttttttttttacacagagtcttgctttgtcacccaggctggagtgcggtggcgtgatcttggctcactgcagcctctgccacctgaattcaagagattctcctgtctcagtctcccaagtagctagtactacaggtgcattccaccccacctggctaattttgtgtttttagtagagatgggatgtcaccatgttggccagggtgatcttgaactcttaacctctggtgatcctcctgccttggcctcccaaaatgctgggattacaggcataagccaccacgcccggccctgtaatttcttgaaaacaattttcaaagattgttttcataaaaataagtagcagctatgtagagattgaagctaaaatctgtttgagaccatggagtgcctatctaaaaccctaatgtcatgaggagatatgatttctgttattgcatttattagataaaactcccagctgcatattaaacatttagcgtgacatggttctacttctttgcattatcggagctcagagcacagtaccccaaagtatggtgccttggcatgtgtggattgttgcactaaaggagacaggaggggtttagaagcaagtagttctctttggccttctcccatccttctgtctcctgaaacaagccataaaatctagaaaggttatcttttacctacctcccctgagagctcataagaccctcattccagaggagtcctgccccttacctggagaaaggaatgctacacatgaaaccgtcattgtaaaattataactgaggcagtgaaagagatctgacctaaccaactccatcttgcttctaacttccaagctgtccttcgtcattccttggcgtaggctgaactaactttggaaggaacttagtttataatttatagtttaaaatgaacataatgacagctctttcccaaaacaaatccctttcttgcttagggactagactgcctttgtaggactaacaaactagtcacaagattagaaattatggtttaggagtcatgcagctggaggctacgaggttctttccagattgctccaggggataacatcactactgtaaagcctaagaccagctcttgagatattttgcagacactgcacttgatggatcagcagccatcaccccgatcgataaactggctcatctgatattgtggccccactcaggaactgactcagcacaagaggatagctttgactccctatgacctgaccaatccgcacacccaactcactgccccccaccagttcacaaattatccttaaaaactctgatctccaaatgctccaggagactaatttgagcaataataaaacttcagtctcccacacagctggttctgtgtgtattacactttctctgttgcaattcccctgtcttgataaatcagctctgtctaggcagggggcaagatgaacccattgggcggttacacacagagagaccaagaagaatcagaacaaacaggccttgctgggctctgctcagtttattaccattagatcatatccattttgtccagttacgttgctccacaactattcacttctttcatcagatttaacataaaaatacagtttccccctgggtgtttgggtcttcatttctgaagcctcctgtgtcaagtaaaactttgattaaatacctttgttatgcttttctcttgttaacctgtcttttgttttgggggttttgggctgtaaaccttgtggcgggtgaagaaaagataggacttttctcccctagagtattttaaaagtcttgcggaggcatgtgcttatgtcaaagatgtctggaggcatggcttgactgttcattcaaagacaaagaaacaacactcatggactttcctgcctggaggaaatgtcacccttggccacacagcttctcagagctacgttcacgtccaccagcggcactgataactgactcctcagcaccgtccagcgaatgctgcatggaggctcgcaggcaccccagcttagaaaggaggagcagaaggtaaatacctacctagtacacaggaaatcaaagagcaaagcttaagaagtgggcttaggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaaaaaaaaaaaaaaaaaaaaaaaaaaaaaaaaataagtgggcttagactcatcaacccctcaaaaatactcagccacttttatgttttcttccccaaccccaagctctcatcctgaggtcctgactgaatctggagcatgtttcagtatctccctaacttataagcgccactgctcattaaggctccctgttagatgagacctctgctgcaacagtctctctgcttgtaaacatcactgcatatatcaccacccaccccagcccagcagggaaaggaaaacaacaacaacaaataaaatgcaattctaggaatagtgagatatgcaagaaggcatcagtattaaactttctgttttgttttgtttgagactgagttttgctcttgttgcccaggctggagtgcaatggtaagatctcggcttactgcaacctctgcctcccgggttcaagcgattctcctgcctcagcctccgaagtagctgggattacaggcgtgtgccaccatgcctggctaattttttttttttttttttttttagtagagatggggtttcaccatgttggtcaggctggtctccaactcctgacctcaaatgatccactcaccttggcctcccaaagtactgaggttacaggtgtgagccatcgcacccggccagtattaaacatttttttaaaaatcatgttgaaacttaaaactaggtagtagaaagtacgtaaaacaattaatagatggttttcaaataccactttcaacttaattactagtcattatattttctcttcagagattgaagagccaagacatcattacacctaaatgcaaaattgtgtgtttacatccaaatctctcatctttcttataaaataggaaataaaattttaaagataccaaatgtgtttagaaccattgaagatagtttaaatattgttaaacatttaggggactataacaaaaagttttgttttgttttttttttaaacgagacggagtcttgctctgtcacccaggctggagtgcagtggcgcgatctctgctcactgcaagctccgcctcctgggttcacgccattctcctgcctcagcctcccgagtagctgggactacaggcgcccgccaccatgccccggtaattttttgtatttttagtagagacggggtttcaccgtgttagccaggagggtctcgatttcctgacctcatgatccgcccgcctcggcctcccaaagtgctgggattaaggcgtgagccactgcgcccggccaagaaaaagttttttaaaaattagtgaaaatattagactctgaagaatagaaataataaataagaaaaatgtaaatgactttctcaacaactttagccactgactcccatcctcctctgtgccctcaaattcaattttcagtgaatttcgcaggccaggagtcatcattcccgttgctgacagctcagctcctcagcctgggagtatccatttttgaacatgcattttttattgtacttgcttttttaacaactcacattcatggtttcattttagaatatccatggtgtaaacaacacattacttcgtgcaatggagacaatattgcttgattgattttgtattactcaaaaaaaaaaaaggcgagaaaagaacttttatctgaggaatgtgagtccttttaaataatgaggcccagagagacattaaaatgaggcagcagtcaaatcctactccccgctttgagctaggtattcatctcctgaaactgcttattgccacaagtagctataaattaacttaataatgccagagcaaacgctataacccacaccctgtagcttaataatgtatagccaatcgctaatcaatgttatttctataaatcaataagaatgcctgacaaacaactttgtatcagccatgccttctcccccttttttgccttcaaaaatctgtttgtaacaaaggccaaactcatatccaaggttacatgggtccgagtcctcctgacagctgtcttcactttggctcagtaaactctttaaattatagagtttgtgtctcagcctcttccttttaggtcgacaaaatgatagagctttggaggtcaatatttatcaaaactgccatctttgggaaatcttctgcataaaagagctggatgtaattgagccagatgctgctttattccacagcactgcaaaatattaccctccctttcaactctaccccaattgaaagcttctggaaatactaagtctctcgtggatatttgtgtacattaacttttaaaagaaattctcgaatggcagctttgctgtggcagctgtcaggcatgcatatgaggaaatgtgttgtaagtgcacagataaggaattacctgatgtttctgtagacagattttcaaactcataattcttttcatgttcatcatcttctccccaaattaaaaaaaattatcgtctatatatttatcttttcagctagggttttcctcatctctatatgcatttctctcattttcaaatatatttttaggatgcgcatgttcagatcatgtggactatatgttatcataacttttgttaaataaaaatatattatccagtatcagctcctcaaacaaaatgactttgggtccataatggctactgaaatgtcaactgacaaaaattcaaatatatttctggcacatcgattatttacttcttttgtatttaaaaatgaaatacaacctgcccaattgtgtaacaggcaaaagcattcttagatcttttacccctctaagaccaaatgcccaactggagcatttatgctgtttgtgcagcattgcccagctgcagagaagcccaaggctcagagggtaagaagtgactggaagttgtcttgctacgtatgtggtgcaggttctttaacttacataaaaatatatttgataagatggtcaatttgcatgagtatttacccaatcagagggtgcagggaacagttatatggagatttttttttaagctattacatttacatcatttagaaatcaaaacaagataagttacctaccaagggtaccttccccatttctacgcccatcatagggagctgagaatggcctgactaataaatttgcattagaattaacaaccacagggatgacatactttacaacagcaacccagggacaaggaaaggggagaggatgttaccaagcctagggaaacaactcaggctcatggtgaacagggagggaaactgatagtgtctaactaacacaattttaaattcagtaagaaaatggtttgttagatcatgtagctcacttactcgccattgaaaaatgctgtgagtgtttccatggaaatctgaattcaaaagatctttcctttaatcatattctgagatttacacggaaaatatctaaaataggctttctttttccttgaacattatctactctatattcaccctcaggggtttttctctcaaatgaatcaaatataaagagaaccttgtagaatactgagttgggttgtggagttgacttatcaagtgctatttttctcattctcatcacagctcatagcgtgttgggaaaaaaaaagatgcctgaatagctcatatgggcaggtggtcagtataattgatttccagttatgtatggttaaaatttaataatagaaaaaacatcctccgtaaagggaagtattgagaatacatctataaaatgttttcttaagagtagaataagttaatctgtggataataggtgtgtgtgtgtgtgtgtgtgtgtgtgtgagaataatccctctaagtcacagatttttacaatactaatatttgaaacacccaagcacgggcacagacaattatgttatgtttccctaattgtccatagcttatcttcaaagaatgaaagaatgttagagatggagggaagaaacagcttaaggaattataagtaacctgcaaaacagaaaagtatatagctgatgttcaccacctttgaatcatgaatagacttgggagactaattttaagaatggcaaaatgttgagacagtttctgtgatgtggtggagtaagacacttcagaacgtgtttgctctgactcactggagcttgtctggcatcaaaaagggtgattcttaattgaccctttgtccaccctgtcaagagcggtcaaaagaacacacaatttagcaggttaaactattttaatttcatcatttaatgggacttcacagtataaataataaaatttactagatgtcatatgaaaccccatgtttcagttcatttgccatattacagcaattttgcaatattgcaactttttcctagtttttataatttcctataaaatgtcttctataatccatctatgtgatttctaagggaaaaagtgatcttatgtaaaaggaaaataaccttggattttcacattagataggaatgtactcattcccacgtctcctggaggaaaaaaataaagaccctgtcaagaaaacattgacagtactataattagtgagtccatcattcatgatttggaaattgacctctaagaaagtggagaaaaaaccccctgtctcacagaaggcaaaaatcatttccatttatgtcaaaataccatcctttaagaagaaatggagggcactgattctgatgagaaaggggaatgcaagtcatgaaggaattgtgaaataaacacacagagaggatctatcctgtcattttatctctaaataaagaactgatcgatgtcttggactcatgttgatgagtagtgagggatggatgtaacactagcgtctgtgcccagatacacgaggataaacgacgtgctacttcatgactctgaggatttgctgccaagatggatatttaaagtgcagaaattcttccacaatattgctgcccttacagagacagggcattggttaggccctgtattttatccaggctaaccccctcatcatacagatgaggaaaatgagtcctggaaaaattatgatgacagaactggtgaactctgacacttcgggttttgaccttggctaaattcttagattttgcccaagaacacactctaaggtttctcgctgtagtttgactgttttgttctgaggattttggaaatagtatctcctgacaggatttctgtgttttttgctgctcaactggctctgaaatttctgaacatgccttatgcagtttcaacattcttctgtaatctctgctgaaacatttttgtacctatattttatatcgatactttcagtgtgtgtgtgtgtgtgtgtatgtatgttctaggacccacttgagaaagattacccagtcaaagttcatataaatgctgcatattgttaggtattgaataagtatttggtatctctttatgttatgaggaagtaaacagtgtatctgcgtttaaatatgaagacagggttacagtggaagcatgatgctatcatctagtgacactcatcttgcagtatcatatttttactagttaagtgttctttattttaagtaggaggtacaggattctgaagcatagtgtaaaagattggaaaaggtttcacagggaaacctgtgggtatgaatcatacatgctgtggaaaccaaggatcttctcaaagtcatagttactggacttcatatgaagccctgtgattaaagaagcaagtcagcttagtaatagccaatattgactgaaaatctgaagggcatttgtttaacctccttaaatagttgttatccaacaaatctgctaaaaaatagttttcaattatttagtacttactgtctttgttcacttaaacacaacttgcaaataagaagtagttattgcaaaaggtagaaatgatcatccaatgtgcaattccttgtcatgaaaaccctccaaggctggtttaaaacagaaacttccttaaatgttctgcaaataaaaattcaagataattaaaatccagaacaaaggagaaaatatttacataaaacacacttctacagtattttaatttattctgaatcatcattgaatagaatattttaatttgttcaagtaaatattttactgtgttcatgataggggcttagtatctgcaagtgatgggccttgttaatcttcagaataagtttaaatgacagctcagcagggcagtgtctcccatgcagcagcccctgtggagcagcaggaaggaaggctccggaggaagctgcaggaagctgatggctcctgtgagaaactgcctggctgatgctgtcacggtgttgaccctctccctaagagccctgagatcacacttgccctttttacatcacccaacaggactgacttaacatccagggaggacaaataaaggggaagaataaaataatccaacaaaaccaggacagaatgcactcatgtcattaatggagctacattcttactttgaatgaattacctacattatgttaccttcctaaagacttactgaaaaaaaggtgttcaaggaactaagggaaacccagggtggcacttgaggttgcgggtcacagaccacactctgcgtagccctgaggctgggtgcagggccaggctgcctgtgtgcagatctcctggccgtgtgttagaggttgaaccatgcatctctcagaattcaaatgttgaatttttatcttatttttatttatttagtttttttgagacagagtctcactctgtcacccagactggagtgcagtggccctatctcagctcactgcaacttccaactgctgggttgaagtgattctcttgcctcagcctcctgagtagctgggattacaggcgcctgacaccatgcccagctaatttttgtacctttagtagagatgggtttttgccatgttggtcaggcttgtctcaaactcctgacctcaggtgatccgcctgcctcagcctcccaaagtgctaggattacaggtgtgagccaccatgcccagcccatatgttgaatttttaaacactgagtactgcagaacccaggaattatttggatttagggtctttacatgggagttaaaatgagattgttgcgaagggaccctaatccaatttgactaatatccttgtaaaaagggaaatttggagacagacacacgtagagggaagatgatgtgaagagatcaaagaagaagacaggtgtctacaaaaccaggaaagaggcctggaatagatgcttcgttcatagccttcagaaggagccaaccctgctggcaccttagtgttagacttctatcctccagaaccatcagacaaaaaatgcccattgtttaagtcacccagtgtgtggctctttgttatgatgtctctagcaaactaatataccttgtgactttggcagttctgtcttcctgcctctgtaaaatgcaaatattactgatatattgcctcctagggcttctgtgaagaggcgatgagttaatacatgcaaagtgctacaatagtgcagacataatattaatactcagtaaatgttaagatgattattaacatcaacatcatcatcaccactgtataaaaaaaagaaaattggggctgatatctgatctctacaactttaccgtgcagcatccctgtccattgctttttctaaattctattattaaccttgagtgtcttgtaattgatcatgtttcaacctttctttgacagcaagtactctcagaaataaaagtattactcggaccaagcaattgaacaacatattcatgcatttatgttcatgtagaaataccaattatacacgttttattttattttattcatgactctattttgtatcttatacttatttccccattgaaatgaggtgaattaaaaataaaaactttataaattaattagctgcaaaaatacttatttttgtttgtttttccaaatggttgcaacttacatagtgtaaaatacaattcatgaaagtggaaagatgcagaaatcagaatggaaatgagaaccagcaacctgagagtcccacagaaatattcagtcacatctgtgtaaccaggggctgtacagtcttaggtggaggtattccagatttttgtttcttagtttctgtcagatgtaaaatgtgtatgtggaactattgtgcactttctttgtttggtagagacagtctctctgtgttgcccaggctagtctcaaattcctagcctcaagtgatcctcccacctcagcctctcaaagtgctggtactacaggtgtgagccaccatccccagcctactgtgcattttctattatttgaagcaaaattggggccacaaagaaggtcatctgtagtatgccaataacataaacctctgacatttcagtaaaatattgcctttgcctctgcatagtatgccagcatgttctgcagggtgggcagccgcaagcagtggttagaacaggggctctagaaccagggcctgaacctgaggctgtgctctgctctccttaatagtgaaatcagaggcaagttgcttgacctttctgctttgtgtttctgcttttgccagatgcacaatatctggtttgtggagttttttgaggaccaagggagatagtgattcctatcaaatgtttaccagagcctctgataatctgggttttcttcctccacttccttcccctccttccttcttcaagatgattctatttaatggcatgttggaaatcatgtcagcagtcatgacatgccaaggtaaaatgaaacttttttccttaaaagtaggagaatgaggtaagagatgattttagaagttaaagcctacccaaacataaaaggatatgatttgtgtcactgtcatctaaagtgtctactgctacattttccatggggctgaagttttgattaaaaagaataatgtcgtatcccaggtgtatccctaaattggtaactacttccgaaagtcttttttaagcttgtacttaaatgacttttttttaaggataatagttttgtattataaaagataaatgcacaaagcagctacatgtaaaatgccactttaggacacgctgttctaacacaaatactgtcaacatatcatttgtgagtgaactgacaagatgtccaaggaatgagttacagtggagaaaattcaacgtgcatcacagaatagttaccagctcctggccctccacagatgtggacctaaaaccacctggagggcagagtcggctccctcccgctgtgagtgcttcctagtgagccagcagctgaaggcctccctagcttcacttctccagagcgggcatggagataactagtgaaagtggtcacaaagtcggggccaagaagtctctaacccctaaatcaagattgagagatactggaccgggcacagtgtctcacacctgtaatcccagcactttgggaggcctaggcaggcggatcacctgaggtcaggaattcaagaccagcctggccaacatggtgaaacccagtctctactagaaaatacaaacaaatttagctgggtgtggtggcaggctcctgtaatcccagctactctagaggctgaagcaggaagaattgcttgagccctggaggcggaggttgcagtgaacccggatcgtgccactgcaccccagactgggcaacagagcgagactcagtctcaaaaaaaaaaaaaaaaaagaaaaagaaaaagaaaaaaagattgagagatactggagaaattcttcctttatgcatccctcatccttgcatcaattttttcctacaaatcaatggagtgtacacatatggggcattatttcacgttaaaggaactaagtccatatacatgatttgttttttgagaggtgaggtctcactttgttgccgaggctggagtgtagtggtgtgatcagacctcactgcggcctacacctcccaggttcagatgatcctcccacctcagccaccctagtaattgggaccacaggcgtgccactgtgactggcaaatttttacatttttttgtagaaatgttgtccaggttggttttgaactcctgggctcaagtgatcctctccccttgagctcccgatgtgcaaggattacagctgtgagccactgggcttggccaagtagaaattatatcctgctactagttgaccaaacatgattcataaactataactagtatggccgccattaatctaaaaattaatttttagattaatgtttattgacagtatctactctataaaatacaaaaataaaatatgcttttatgatgtggaccatagtatccataagattgcttttctgtttgaattggctataaaaatggaaaaagtatcattttgtaactgtgtggcatttgttcatttattcaacaataataccagagcggaaagcaacaagttaggtgtgacataatatagaaatggttttgttttgtttgtttgttctacatatattattagtaaggtttctctagagtactgtctctctctatctctttctatctctgtctacacatagacacacacacacacacacacacacacacacacacacagatgttcctcaacttacaatggggttatgtcacaataaacccatcataagtttgttacaggaaagaggtccagatccagaccccaagagagggttcttggatcttgtgcaagaaagaattcagggcgagttcacagtgcaaagtgaaagtaagtttattaagaaagtaaaggaataaaagaatggttactccatagaaagagcagccccaagggctgctgattgcgctttttctttttttttttttgagatggagtcttgctctgttgcccagcctgaagtgcagtggcactatctaggctcactgcaacctccccttccagggctcaagtgattctcctgcctcagcctcctgagcagctgggattacaggcgtgcaccaccaggcctggctaatttttgtatttttagtagagacagggtttcaccatattggtcaggctggtctcaaactcccgaccttgtgatccacccgcctcggcctctgaaagtgctgggattacaggcgtgagccaccacacccggccggttgcccatttttatggttatttcttgagatttgccaaacaaggggtggattattcatccctccccttttagaccatatagggcaactttctgacgttgccatggcatctgtaaactgtcatggtgctggtgggagagtagcagtgaggacaaccagagtcactctcatcaccattttggtttgggtgggttttggctggttgctttactgcaacctgttttatcagcaaggtctttatgatctgtattttgtgctgacctcctatctcattctatgacttagaatgccttaaccatctgggaatgcagcccgggagatttcagcctcattttacccagctcctatttaagatggagttgctctggttcacttgtctctgacaagttgaaaatgcatttaatacacctaacctactggacctcatagcttagcttagcctaccttaaatgtgctcagaacacttacattagcatacatttagcctacggttgggccaaatcatctaacacaaagcctattttataatgaagtgttgaatatttaatgtaacttattaaatactatgttgaaagtaaaaaacaaaatgcaatctttattattttagctaaagtaattgtcaatttattaaataaaaacaaaacagcccacaccatcattagctgaaaaatcgttttgaaccattgtaagttggggactgtctaaagaattgtgaattggctcaagtaatgacagaagctgattagtatggaaatttgaagtcagcaagctggagacccagcagaggtaaggtatagtccaaaagcttgcagccttgaggctcaagaagagccaatgttttcgttcatttaagaaggtaggaaaagaccaatgtcccagttcacacagtcaggcaaaaggagctccccagtactcacgggagggtcagctgtttcgttctattcaggcctcccaccaagaggatgaggtccatccatactggggagtgcagtgggcttcactcagctagagattcaaatgttaatctcattcagaaaacaccctcacagacacacagaataatgtttgaccaaatatctgagccaccctgtggcccagtcaaactgatagtttttccttaggttatctccagtgtcatttaaatattaatatttatagtatattatatattgatgtaaatattaacatttattacccaggggttgtgttctcttgataatgttctatttttttaatctctgtgaaaaaatgttttatgaagtgtggaatttatctactacactgacatattctgcattaatctttctctattttgtggttgtcaatcactggtacagtttcagagagcaggaaataaagattcagcctttaactcctacacaatccacagtgtttttttcccctcagaactgtcataaaactgttgtattttatttagatttttaaattaacaactaaagccatattctagtaatactttaataatctagatttcctatttttggagtagaaggctgcatcatatttaaaatcactgcagagactttgaggttttcaaattaatatcatattaaaaatttttgcactctgaaggctttcatttattgctttaaaaaaatgttgaaactcagagttcaaatgattttaaaaactctacatctagatacagttaatgtaaactttgtatatctctgtaatgactttcactgcccctcattatcaatcaagagcattgagataaggactggaaaatattaaatatatatgttaatatttatataaacatattaaatgtgtgtgtgtgtcacacatacacacacagagcaagagaaagagcaagagagggacagtaactgtcttcagaatatcaaaagttctgctaatcggctcttttgcagaagcttgtcctcactctccgcataggggaaagagaatgagctttaagacagaacttcctgctgaattaattaaatatatccattactactgacagaatcagtgaggttaagcccctctgaagatgacaagataaattgtcactattatggcactagaaatgagatactgggatacgatttcattaccgtattatcataggtttacttaattggcaaagtttcacttaagaaggatgcagaaattctgaacacaagttagcatttctagcacgatggtacaagatgtgttattgaataagtcaaagatgccataaacgcaaatttcaaggaatggcataaggccggggtggtggctcacacctgtaaccctagcactttgggaagctgaggcaggtggatcacctaaggtcagaagttcgagaccagcctgactaacgtggtgaaaccccgtctctactaaaaatacaaaattagctgggcctggtggtgggtgcctgtagtcccagctacaagggaggctgaggcaggagaatcgcttaaacccgggaggcagaggttacagtgagccaagatcgcaccactgcactccagcctgagcaacaagagtgagactctgtctaaataaataaataagtataaaaggatggcacgaatgcaaaactcggtgcacagtgcgctgcagtgccgcctgctgtctgatggaaacatcacaaagacacaagcacagactaagaaaaaaagttttaaaagtcaaagggataggtaagtaaaaaattgaatgcaatatgtaggaaatgctgctttcttatttttatttttattttttatttatttatttatttatttttgagacagagtctctctctgtcgcccaggccggagtgcagtggtgcgatctcggctcactgcaagctctgcctcccgggttcacaccattctcctccctcagcctcccagaaatgctgctttctaaaagtggccactcttatgctaataaagtcatccatgagacaagaacgtgcttaaaatataatagcgcatactgaaagcaatactgctttgtccaagtcagtcccattagtcctggcatgatttctgtagcactcctttcaaataaagaatgtcccaatttgaatgaagaaaactatataatcatcctaatcatgatagcaagattaagtcatcatttgtagtaaaatcttacaacagattgtgactggctgtgtagtgacaaaataattggaaagtggcaaataaaactggtcatagagggtcttagactatatttgttgccttgaagacatgatgggagaattaaacttaataaatgacctcgtcctagatgaaatatccttcttagaccaaatatttctgcaaggtatggattgaatcttcataccaagtccaacgaatttttgtcctgctggaaactaattgagaaggaaattaacaggaattaaggtgagatgaacaaggtgagttgcaaaagtgcaggctcagatcctgctaaattttaatatttgctcatggtgacttttttgcattaattttaatatttttaaataatgtattaaaacattatttattttgattgctaagttttgtgcttacccatttaattgtgttcctaaggggagtacctcacttacctcaccttgtaacagattctatacaaggtatacctgggattagatataaagaacaatgaagtcagaactgtgatatgggggtttccactccagctacctgaaactgaggttgccctatcttagtgagttcaaagctggagattctgtaaatagacacggggactgtgaggtccctgcacaaacaggtcatatctgtaaattaaactttgtgattataataattttttttttgagatagagtcttgctctgtcacccaggctggagtgcagtggtgcaatctcagctcacagcaacctccacctgctgggttcaagcaattctcctgcctcagcctccagagtagctgcgattacaggtgcacaccaccacacccggctaattttttaatttttactagagatggggttttgccatgttggccaagctggtcttgaactcctgacctcaggtgatctgcccgccttggctttgagaacaagaataccatgtctgctggtgtgttagtcgattttgtgttgctataaagaaatatgtgaggctggataatttataaagaaaagaggtttatttggttcacagttctgcaggctgtacaaaaagtgtaatgacagtatcagcttttgctgaggccacaggaagcttacaatcattgcagaaggcaaagtgggagctggtgtatgacatggtaagagagggaacaagagagatgccagactcatttatttatttatttatttatttatttatttatttatttgagacagagtctcactctgtagccccagctggagtgcagtggtgcgatcttggctcactgcaacctctgcctccaaggctcaagcaattcttgtgcctcagcctcccgtgtagctgggactacaggtgcactccaccaggcctggctacttttttgtattttagtagaggtgagctttcaccatgttgcccagggtggtctcgaactcctaagatcaatcaatccgccggcctcagcctctcaaagtgctgggattacagccgtgagccactgtacccggcctagactcctttaaacaaccagcttttgcatgaactaatgcagggaggacttattcgttactatgaggaaggcatcaaaccattcatgaggtctccacccccatgacccaaacacctcccaccagggcctacctccaacatgggaatcacatcttaacatgagatttggaaagaacaaacatccaaactatatatatatatatattttttttttttttttttttttttgagatggagtcttgcactctcgcccaggctggagggcagtggcacgatctcggctcactgcaagctccgcctcccgggtttacgccattctcctgcctcagcctcccgagtagctgggactacaggcgccagccaccatgcccggctaatttttgtatttttagtagagatggggtttcaccatgttagccaggatggtctcgatcttctgaccttgtgatcagcccgcctcggcctcccaaagtgctgggaattacaggcgtgagccaccgcgcctggccatctaaactatatcagctggtggtttgccctaagcttttctcccctaagtttcttttttcagaaataaagtttgtctttatctgacgtcagcagattggtgtttgttttgcctgctgtattcctttagtttctaaaatagtccaaattcctcacccttccctgaaaatgttgctcttacgttgacataatgtctagtttcattcagcagttaatattataatatagtactcagattagagtttgctgctgttgtcgttaaatttaggtcattctaaatttacaagttagttgggaagaaaacaaccgcaaattctcaaccctcatcaccatttctgcctctcagtgctcatataaagtcactacagaaaaagaaggaatgcagcaattaaacaagctcatctgtaacacgattaatttttaactctttaattcacttgtttctcataggaaactacattaacatgacaggttgttttttttttgttttttttttttgagacggagtctctctcttctcccaggctggagtgcagtggcgccatctcggctcactgcaagctccgcctcccaggttcacgccattctcttgcctcagcctcctgaatagctgtaattacaggctcctgccaccacgcctggctaattttttgtatttttagtagagacggggtttcaccatgttagccaggatggttcttgatctcctgacctcgtgatccgcccgccttggcctcccaaagtgctgggattacaggcgtgagccaccgcatccagccatgacagtaatttttgaaaatgcattggcacagcaattcaagaagaggaaattggacccatggtctctaaaggactccccagcaataatgtgctgggctgttcagaattatcactgagaaaaggctatgcccatgtgcacaactgacctgacctcatgtgcacatcagttcacctcaaccaccatcccgtctgctaaaataagtcacattggttgcctcccaaagttctctattcaaaccagtaaactcagttaaataggttgtgaataggaaaatccaaaagtcactgggaaaagatgttataaactaaaatattcatagaaactttttttatgaaagccaaaaaaggaaaaataaacaactaagatgcctaaaaaccaaaaaatggatgaataaaatgtggcagatgcattcagtggaatatcatatagcagtgaaaattaaggacattaattacatgtatcagcatgcctgaatctcaaaaactcaagttgaacaataatagcttttaaaaaatcacagagttaatatgtatgttccaagtctatgaagtcttcaaaaagaggaaaaacaggccaggcacagtggctcatgcctgtaatcccagcactttgggaggccgagatgggcggatcacgaggtcaggagatcaagaccatcctggctaacacggtgaaaccctgtttctactaaaaaaccaaaaaaattagccagacgtggtggcgggcgcctgtagtcccagctactcgggaggctgaggcaggagaatggcatgaactcgggaggtggagcttgcagtgagctgagattgcgccactgcactcccgcctaggcgacaaagcaagactccatctcaaaaaaaaaaaaagggaaaaacaaaagagtatattcaaagaatcacaaacaaaaagtaaaggaatgataaacaaaatttaggatagcgtttaccttggggactaataaatatgggtaatgtttaatttattaagctaggagatgggcacatatattttcattcatagaactttttttcctaaatgtatgtgtatgatatatgtcacatgcatgacatatatgtgcatgacatgtgatatatatgtgaactacatatagttcacaaaaactaaatgtagatatggtatacaatcacacaaaagcatttaatgtatcaatgtgtctatatatacatttatgcctaacttatgacaataaatatactctcaaatacctggtcgtcattaaatctaatatgtagaatattaaaatatgaaagaggatgctgtatttgttattagtcatttttctccagtctattttcttttgcatcatttaataaattagtagagaactttcctcccattccttttagtgttttaaaatcttttaatttaaaaattatagctcttagataattgccttatatattgtttttaaattttgtttcctatgggttgctgtaaatctatcctaagtggcaaagttttaaaaacaatatgggtcaaaagtgcacaaagctctgaaaatgagaaaagaaaatgaccaaacctttaagattcctagcattattctgcctatcaccataatgtttgcttggagggaggcaggctatgaactgaacaacctaatttatggctgatgtgctctctggccattatgggcagaatgtgggcttcttcacagcagtggctctcagcatttctcttcatgttctatgggctacagcaagtcacatgaccaatcccaactccattgtgtcagggatgtataatcctcttacttggaggacagcaagtaattgggaacagtaatacaatttggcacacaaaacaaatcttcagagagtgtcagggtcaagagaagcatttgtccgagaaaaagttactctaaacttgcaaaaagataaaaatcataatgcttgattaaaaaaatactgaattattttctaattatttacttgaccctaacctgacaacatttataggagtgatatcaagtcagactatttacagactgtgagtctagaggtcagcagcaaaatttagaaattatcatgactctgtagcccagtggtttactgtcataaaagatatattttataatgaaatagaccaccaagtagaacaacagaccactgaaataaaccatcaaatgacatcctataatttaaaggtatgatgaaaaatggaaagagttgtaaatgtttcttctagagttgtcatttggtgcttctgttagaagggctatggaggaggccgggcgcagcggctgacgcctgtaatcacagcactttgggaggctgaggctggcggatcacgaggtcaggagatagaaaccatcctggctaacacggtgaaaccctgccactactaaaaatacaaaaaaatcagccgggtgtggtggcaggcgcctgtagtcccagccactcgggaggctgaggcaggagaaaggcgtgaacccgggaggtggagcttgcagtgagccaagatcgcgccactgcactctagcctgggcgacagagcgagactccatctcaaaaaaaaaaaagaaaaaaaaaaaagtttgacacagtttgatctttttctaacacctggtggcatttttacagcataacctttaaaaagtcattctagaatatcctaatagatgtatacatccctctacctaaatttttgtagatgttatttgcctacatagtgaatgatattgtatttcagcggaatttattattcaacttttaaaaacaaatctcctgcatttacatccattttccatatatctatgtcataaagataatgaatttaattggacaattttctttcaaatgtgtgcagcctccttccacttccaggtctgaaagaggacagtatattttatagaccacacgattgccagagtggaaactggagtgagtggaagattccacatagttttacttgtgatactctagagactagtggtgaggtgtcttggagatggcataataatacaaataactaaatattactgagttgttactgtatatggcactatgttaaaggtttcataggcatcactcctcatcacaacaataatagcccacctcggcctcccaaagtgtctgtcccttctttattcaccagccacaatgacacacagaacatagtaggaagaaaatagtttatatttattcctaagaatataaacttctgttaccattctaaatttccagaaaaacttattgtgagtgctaaactaatatcatactgacctaagacaaattgtcagttcctaagggtgagatttataggagaaaaccatgtctacgcttgaggcagagttcttagtagagatacaatagccagttgctattatttcaaagtttgtctgtccctaaatattgcctgcttaggtctgactatgctaggattagtgatcatctgctctgaattaaaggtttagatgcgctcttcccaggataaaattaagtttggggactttctcttttcctgggagcaaaaacctcaggaactaagtgccatatgctggaagatggaaacattccaacagccagaagtagagggaagataaaaatggcttccctaaagcaaggcaaatcagcgacagccagtcctgtggccaccactaatcacttgtaaatgaatgctgcgatgtgtttcaaaagccctcattctgactctgcctgatctgctactgaaatgttaattatatgcctaatcttctcttgcaagcaaaggcagcagagttgctaaagatcatagcaggtaaaagccttcaaggagaggtaaggagtaaatggagctgggagagaatgctgtctctcaggacagagcctggctcattgaaagggcatagtcctaccctataagggatgcctcccagtgtgaccaggtcttctatgatttctttttatgagaaaccagaaatctgattatgttcatgagaaattggagttttacaaattagcaaaactgtgctgtgctgagaaaatagaataaacctgaaggccagaggtgtgctgggagagtcacttacagaaccagagcaaatacttagatagagcaatgatgtgttttaataaaaacagggactactgtgctttgtaaatgtctttatgccttctaaacgtcctttctcctgaagtctataatgtgacatgggatagcaaagtattttttggcatgaaccattgcattgaatatcttaacccatttgtgttgctattaaaaaaactcctgagactaaaaaatgtatttaaaaaagaggtttatttggctcatgattctgcagcccatacaggaagaatggcagcagcatctgctcagcttctggtgaatttctcatgttgcttccacacatggcggaaggcaaagggaagccagcatgtagtgagatcacatagtgagaaaagaggaaagaggggggagggggtgctaggctctttgtaacaactagctttcttgggaactaacagagagctcattcatcccctctccccagggagggcaagaatcttttcatgagggatctgctcccaagaccctaacacctcccattaggccccacctccaacacaggggttcaaatttcaacatgaggtttaggagacaaacatccaggctatgtcattggatccctaataggctgaagtaatgtgttaaaaataagttgtaaataattatatgcaaaaacacatagcattttggaaactttgcaagataatgaaaatatttatctggattttaacttaattcactccatattctacacaaacatatttttaaaagataatacaatatttgagacattaatatatgttaaccaatttacatcctcaagagctaagaaagtgttaagttgccctttcttaataaaaacaaaatttatgatgttaactgttttttgtttgtttgtttgttttattgagacagagtcttgccctgttgcccaggctgtagtgatcatggctcactgcagccttgacctcctgggctcaagtgattcttccacctcagtctttggagtagctgggattacaggcgcatgccaacatatctggttattttttgtagaagctttgtttcaccatgttgcccaggctggtctcaaactcctgggttaaagcaatctgcctgccttgaccttccaaagtgctgggattttaggtgtgagccactgtgcctggcctatgacgataacttttttaaaagacaaaattagaacaaatttagttatagatgtaattggcttctatttgtaagtcatgaatcagggcagcctgcattctacaaaataggatgagagcttccacagacaatggaagaacagtagcttctgtaaaatgagaacaattaaacaaaacaatagacaaaaagctgattggttaagatcagggttaatccaggttaatttgttgtaagggttaaagcagagaaaagttcctttttgcactgactcaggtagaccggaatttcctgtcttgaggaaaaactgctctgttctgggacctgtgtactttcttaaagtttcagtttgattatgtggtttaacatagcacatgaataacaatgcgattattttaaaagagttattataataaattttgataaatttgctcaaagtcattatctctaataatcaaattatctcaaatttaattaattgcagtatgtgtcatttatttcaaaagtgaaataaaaacctgttccacaaatcacagtttagtttattttcaaattcaaactttacttgcttcactgaatctagcaaaagtaaatgtttcaaaataatgcaaaaaaaaaagaggtttgtaaagttggtaagaaaatatttgctgagcaagtaatcagatgtttattgtcttacctatgtcatttcttatatatttacattcacattgatttgtattagctatcaagttaatcatgttaaaaaaagtggtaccataatgaattgtgtttgatgttgaaattaatatttaaagatttaaaaattatgagagagtattctgtgttatctcagaatactggtaatgtcttaaagatttctggctacaaagtagttttacaagacattagttttatgggcactgcatgcattgcattgatcaaagcagcattgcattggtatttaacactaggccatgactgaaagggcttcagaagacatcatgatgaactacatacagagtaatggcaagtttactataaaattaacattctcagttgtcacaagaaatctgacaatcactaaaatggcaagcactgtgttctatttgtgtccttttcagacatgattgataagaatttgttaccttattagcatgtcataagtagacagcaaagtatgttttaaattcgaaaattattattttctgctcacgttctactttcagcaatgtacacagtgatagtaatgaaagcagccatcagaatagtctattttcttcatagttagctgccaaatacttctttttttctatccagatcatacttgtattgcttttgtgcctttgagcatagtcataaattagtacacagaggaagcagggcagtgacagctatacatttttctatagaagatcagctattaaatcaagaaccaagagaaccatctcagcctggacactgagaaccgaagccacaccttcccactgatattaacatgactttgttattctattgttccattagtattacttttcgaggactgtcctacctaaagaatggtttgatttttcattataggaacttcccaaatgctttatcaaccttcaggggaagtcatagaccgagtttacagcttgagtctttgaatccttccccacaaatcctcacctcactattttctctaagcccagactgttgtatcatgattctcacacaattctaatcaaatcctctccttcagagacccatcttaaaccaaacttgcaattctcaataaattctgatctccccttctctcctctgagatgctgatagaaatttacaaaggctgtactctctcccttgccagtgtattagttttctattgctgctgtaacaaattaccacaaacagtgttgtaaacaatccagacttgttatcctacagtcctcttggtcagacattcaatgtgggtctcactgacctaaaatccaggcatcagcagggtagaggttcctcatgcaggctctgggctcctgtgtctgacttttccagcatctagaggctgcctgctgtcctcagcccctggccccttcctccatcttcacagtcagcaatgataggctgggaggccttctcacgctgccatctctttggttctttctcttctgcccccctcttccacttttaagaacttgtgattagccccatctggataatccaggataatctccctatttcaaagtgagttaacaactttaattccaaatgtggtcttaatttccatttttcatgtaagttcacatgttcacatattccagagatgagtgtgtggacatctttgggaggtcaattattttcctgccacataggtaagcaataaacttcgcaataagccgggtgctgcggctcatgcctataatcccagcactttgggaggctgaggcgggtggatcacctgaggtcaggagttcaagactagcctggccaacatggtgaaaccccacctctactaaaactacaaaaaattagttcggcatgatgtcacatgcctgtaatcccagctactcaggaggctgagacaggagaatcgcttgaacctgggaggcagaggttgcagtgagccaagactgcgccactgcgctccagcctaggcgacaagagcgaaacttcatctcaaaaaaacaaaaaaactttgcaataaataagcaatcaactttgtctcatcaacatgttatgttggtgataattggggatacagctttgacaagcaattagcacaaacatgacctacttgcagaaacttgtcatagctattattctaaatatggtaatagatgactgtaataatccaagccaagaattatgacattttaaatccacacacactcttactcctggaatatcctcaaatggacattaacatacaaatattttaattagattcttttaaattcttaagattatgtgatataacccaaaagtggggctgaaatgtcaggtgacaataacacccaaatggaggttccactcagcacctccagggacaccccccccaacatatatacactctttacagaaacatatttggaaatgaattcattattcataagtagttgtgaatagttagaaaatagattttacatttcacattcaataaaactcccacagaatgtcaattctgattattcgtggattttgtattttcaaatccaccttcttgctaaaatgtatttgtatttgcaaattcacccacctgctaaaatttattactaaccccaaaattcacactcacagcacctttgttgtcatacacagactggccaaaaatttcattctcccagcttgcacattcccagctgatgttgaacaaaaccgtgttctgccttcttgtttcaactctcatactaaaatcaagtgtccttttcacaatctgtttagtgtcgtggttttcatatttttgtgcttttttggtgattttgatgtttacaatggcccccaaacatagtgctaaagtgctctcaaagcacaaaaagaccgtgatgtgcattatggaggcacatgtgacataaactttgttcagatatgacctatagtatagtgccattggctataatctcaatgctgatgaataaattttatatgttaaataaggagtctttaaacagaaacacatataaaacaagattatgtcttgatcatttgatgaaaatgttgcagccagaggctcacagaaacttccccttacattttcccaagaagcaacaatttaatacttgctaatgttggagctctgaaaaccatatcctcaaaaatggcactttgacatgttgagtgctttgaattaaataaaattgaaaggcctcagaaataagcctcaggaccaacactctgtctaacaccatcagcccccccaaccccaccctactgtattagtctgttctcatgctgctgataaagacatacccaagactgagtaattgataaagaaaaagaggtttaatggactcacagttccacatggccggcgaggcctcacaatcacagtggaaggcaaaaggcacaccttacatggcagcaaacaagaaagaatgagaaccaagtgaaagaggtttccccttataaaaacatcagctctcatgagacttattctgttccaggagaacaatatgggggtatggggggaacagcctccatgactcaattatttcctactgggtccttcccacaacatgtgggaattatgggagctacaattcaagatgagatttgtgtggggacgtagccaaaccatatcacctaccatcctctttctttcctgaagcaaggaagcaagaaaggagaggcttttgctgaagtttccttatctgattaagtctgaccaagggaggtttctccagaagaaatgcagtgtttttgtttgtttgtttgtttgttttaatttagcccagtcaaattgacatatacaaatgcagggtttttttgtttgtttgtttttgttttttgagacggaatctcgctctgtcacccaggctggagtgcagtggcgtgatcttggctcactgcaacctttgcctcctggattcaagcaattctcctgcctcagcctcccaagtagctgggattacaggcaggtgccaccatgcctggctaagttttttgtatttttagtagagacaaggtttcaccatattggccaggctggcctcgaactcctgaccttgtgatccacccacctcgacctcccaaagtgctgggattacaggcatgagccactgtgcccggcctgttttttttgtttttttttttttgagacggagtctcgctctgtcacccaggctggagtgcagtggcccaatctcagctcactgcaagctccacctcccaggttcacgccattcttctgcctcagcctcccgagtagctaggattacaggtgcccgccaccacgcctggctaattttttggtattttttagtggagacggggttttaccgtgttagccaggatggtctcgatctcctgacctcgtgatccaccctcctcggccttcccagagtgctgggattacaggcgtgagccactgcaccgggccagaaatgcagatgttttaaaactccctctctacagatcttatcatataaccaggaaagagtaaccaccagagaggagaaaataagtcattaccatgtccagacagacttttcatctatccttctgagggcagctcagagagattatgggaaagattttatctgcttaatgacaacctttgtttacaatgaagttctggtctcacgtttccataatttgtttgtacctcccccagagctcagacaaactttgtaccaggccaattgtcttttctttgagctcattcattttccctaaaataatttactttccctctagatgtgcccacagtcccccttttccctgtcccctgtgaataggatatttaagaattaaccaactagagggcatttaaggcttaaccaaagctcttctttgagtctcatatttttaggactcccatctccatgtgcatattaataaattgtgtgcatttttcccttgttaatctgtctattgtcagctcatttcagcagtgaactatcagagggcagaggggaagatttctctctgcccctacagtaatttgatatttacagaaactttatagaacataactactgtgaataatgagaatcaactgtatatgtcacctttgaatacctctcttctctcttcactgcattcctttggcacagagatggagccaaactctagtggctagggaagtaaataaaagactgggtctgagtcacctgtttccctaaaggtagcatcaccctctgaaggtgccccttacaggcctctctgggaagggtttcacaatctcctcccacactttacagttggcaaattatggagccaagggccaaatccagtgcccatttgggcaacaagctaagaatgttttctacattaatgacaggctggggaaaaaaaaaaacagcaaagaaaataatatgacctaaaactgtatgtgacacataaagcctaaatatttactatctgggcctttacagaaaaagcttgctgaccccttctttgcagcctagcaaagatatactagatagcaaatatctagtgtttgggaaataatttaaaacaaaacctgttcaggaaacctctccacaaaagtagaatagatgttgttgaataagcactaaagctcacttcaatgtgcatcacaagaaatctgccaaagagattgaaaaacagacagaaatctcaccctttcatgtggccaagtaggtaaaaccctcacatacacgttctcaagatcgatgataagtagtttgcaagttagtaaaaggacttgacagcaccacttgccacatagaattcatcccagattcactgggtaattgaaattggccatgggtgcttgctaattacctttatcgaaaggaaaaacaaattctcatatctttataccaggaggtagttttgcaatgtggagcccgacgcctaggtaacattaggttcctaccctcccatgaaaatgtcaataaaaagagtccaactttgtaacacatttgtagaaatttattctgagccaaatatgagtgaccatggcccatgacacagccctcaggagatcccgagaacatgtgtccaaggtggttgcagcacagcctagttttatacatttcagggagacatgagacatcaatcaaatacatttaagatataagttggttcagtccagaaaagtgggacaactcaaagcaagggggtgtccaggttataggtagaatgaaaaatttcggattggcaattgcttgaaagagttattatcatagaaaacaatgtctgggttatgataagaggttgcagagaccaaagttttatcatgaagatgaagcctccatttcgcaggcttcagagaaaatagattgtacaggtttcttctcagacctaaggcttgtgttgatattaaatggtgattggtttttcctgaattccaagaggaaagagggcataatgaggcatatctgaccctccctccccattgttgtgggacttttccttagttcagctaaagatgcagtctttgtcccatggccacgaaaatttaggcttgcagacgagttgaagggtgagtaaagcagggttttattgggtgaaaaggaaaaaaaaagggggaacagggaccctctgcaaagtcagagtctctgctggtgtgcttcctgccttgcagattgaatcccagtttccacacaggaagaggtgggaccaggctcctccctctgcaaacagtgcaaacttctgtggctccaccccaaggtgcattccttccagtgtgggctggttgcagtttcactggggaccctctcccacctggctgtctcaccatcatggcctaaaccagtctttcaggttaaatttagggtgccctggcagaggaggggtccattcagatgtttgtgaggggtggagggggtggctatgagttttatttttggtttataaagatgaggggatgaggtacaatcctccttggtgattctatctcagagatagttccagacccttgagaaacacattcctacattgtaaaacctgcaagagacttatcttttttctttaaaaaattgctatatccctaagaagcagagaaagaatttatgtttctgaaagaaaatgttctgaggaaatggtggtggtggtggtggagatctctttccctttttccatcagggagaattattatttttttcctatgttccatttgtatttactgttacactagttaactaagtatctagccaaaaggaactataatttgagaaggtggttcccatgacttctcctctttcttttctttcagacttctgcttcctcagaaatgccctcattttgtcccaaggtactcagatctgtcactctacttgaatccaatcagcaaaacaacagctctgcagttagctgacttgcttctaacctccatcatctaaagtagaatattaacctcttatatcgttattcaaaattgtcacctggggtttcagctcctattctaacaggtcaatagaagcatttcctgaagagaaacaggagtgtgtgtgttttgggagtacggaagatatttctactaagaaaaggagtttttctccacagtgttaacattagaaatctagcacctatcatttcacaaattgaatacctgaggcttagggaggtgaagtgacttccttgaaggagacaagtagcaaatgtggaggttcatgtctgcagcctatagaacccaggaaccctctttccactatgccagactaacctgggaacccaattagctgccatcaaaagtataagaattctttttatttgcctattatctctcatgataagtgaatcaatcacttactgagcacaattcctacaaagtgcaaaatgaccaaagtccccagagtagcttcctctacatcgtgagctgcaactccagtaaaagaggctggcaactctcaaagacaaaatgcactggactgtggagcatatgatttcattaggactatttgtaatagagagaacatggccagatctcagcaggttgtgactgttcaactggtggtataatttactatcaaaattattctgcaatcgggggggtcttagtcaactcagcaggaaatgtttatcttaggattttgttagtttggagggacaaacagttctaatcttagctaattaataatgagacaaagaatgggtggttggaggatctgtgttttgccttgtcagcagacttaggccaaaggggaaaggtctgtgtttgatcttgtcaacagcaatgtgctaattgtgactcctaatggggatggagctgggtgtgtgcttggacatggcattccatatgtgcccagggcatgctgtctttttaagagaaaataagaatctgaccaggcacggtggctcatgcctgtaatcccagcactctgggaggccgaggtgggcagatcacgaagtcaggagattgagaccatcctggctaacatggtgaaaccctgtctctactaaaaatacaaaaaaattagccaggcgtggtggtgggtgcctgtagtcccagctactcgggaggctgaggcagaagaatggtgtgaacccaggaggcagagcttgcagtgagccaagatcgcgccactgcactccagcctgggcaacagagtgagactctatctcaaaaaaaaaaaaaaaaaaaaaaagagagaaaataagaatttaatttcttcagggatcctgagtatctctcattacctaaagtgttcatttattaccaaatgattaactttctatttatgtgtgaggtttgtgggagaccatagagaagttttgtttaaaacatctacgtatttctttacataattcatttattatatcccttgttgaatgttctggctgagaaagatttaatttaagctttccatcaatgagaacaaagatgaggcttgctgaaatatgttgatgttcactggacagcaaatatcctgctctgttctatattcaaagttgaaaagtgatggaaacctcatcctcatcctcagggctcagaaaagtcacaaggtctttgactttgaagagtggaacaagagggcaacatgttttctagtaagtaaagtaagtgaggctatggagtaggtttcagagtggcactttcaatcttactcggacatgtcaaagtctttacaaaggcttcttctagacctgtaagcctagaattaatataaacgctcacctaggtcaaattcaatgatatttatcttaaaggactttcaaatctaagtgggtctcaataaggcaaacccttctgagtcttttatttccctaagcataaaattctatcttctctaccttctgtacttctcagcattagcaaaggaatctcatgataattgaattcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaattcagggcgagttcacagtgcaaagtgaaagtaagtttattaagaaagtaaaggaataaaagaatggttactccatagaaagagcagccccaagggctgctgattgcgcctttttttttttttttttttgagatggagtcttgctctgttgcccagcctgaagtgcagtggcactatctaggctcactgcaacctccccttccagggctcaagtgattctcctgcctcagcctcctgagcagctgggattacaggcgtgcaccaccaggcctggctaatttttgtatttttagtagagacagggtttcaccatattggtcaggctggtctcaaactcccgaccttgtgatccacccgcctcggcctctgaaagtgctgggattacaggcgtgagccaccacacccggccggttgcccatttttatggttatttcttgagatttgccaaacaaggggtggattattcatccctccccttttagaccatatagggcaactttctgacgttgccatggcatctgtaaactgtcatggtgctggtgggagagtagcagtgaggacaaccagagtcactctcatcaccattttggtttgggtgggttttggctggttgctttactgcaacctgttttatcagcaaggtctttatgatctgtattttgtgctgacctcctatctcattctatgacttagaatgccttaaccatctgggaatgcagcccaggagatttcagcctcattttacccagctcctatttaagatggagttgctctggttcacttgtctctgacaagttgaaaatgcatttaatacacctaacctactggacctcatagcttagcttagcctaccttaaatgtgctcagaacacttacattagcatacatttagcctacggttgggccaaatcatctaacacaaagcctattttataatgaagtgttgaatatttaatgtaacttattaaatactatgttgaaagtaaaaaacaaaatgcaatctttattattttagctaaagtaattgtcaatttattaaataaaaacaaaacagcccacaccatcattagctgaaaaatcgttttgaaccattgtaagttggggactgtctaaagaattgtgaattggctcaagtaatgacagaagctgattagtatggaaatttgaagtcagcaagctggagacccagcagaggtaaggtatagtccaaaagcttgcagccttgaggctcaagaagagccaatgttttcgttcatttaagaaggtaggaaaagaccaatgtcccagttcacacagtcaggcaaaaggagctccccagtactcatgggagggtcagctgtttcgttctattcaggcctcccaccaagaggatgaggtccatccatactggggagtgcagtgggcttcactcagctagagattcaaatgttaatctcattcagaaaacaccctcacagacacacagaataatgtttgaccaaatatctgagccaccctgtggcccagtcaaactgatagtttttccttaggttatctccagtgtcatttaaatattaatatttatagtatattatatattgatgtaaatattaacatttattacccaggggttgtgttctcttgataatgttctatttttttaatctctgtgaaaaaatgttttatgaagtgtggaatttatctactacactgacatattctgcattaatctttctctattttgtggttgtcaatcactggtacagtttcagagagcaggaaataaagattcagcctttaactcctacacaatccacagtgtttttttcccctcagaactgtcataaaactgttgtattttatttagatttttaaattaacaactaaagccatattctagtaatactttaataatctagatttcctatttttggagtagaaggctgtatcatatttaaaatcactgcagagactttgaggttttcaaattaatatcatattaaaaatttttgcactctgaaggctttcatttattgctttaaaaaaatgttgaaactcagagttcaaatgattttaaaaactctacatctagatacagttaatgtaaactttgtatatctctgtaatgactttcactgcccctcattatcaatcaagagcattgagataaggactggaaaatattaaatatatatgttaatatttatataaacatattaaatgtgtgtgtgtgtcacacatacacacacagagcaagagaaagagcaagagagggacagtaactgtcttcagaatatcaaaagttctgctaatcggctcttttgcagaagcttgtcctcactctccgcataggggaaagagaatgagctttaagacagaacttcctgctgaattaattaaatatatccattactactgacagaatcagtgaggttaagcccctctgaagaggacaagataaattgtcactattatggcactagaaatgagatactgggatacgatttcattaccgtattatcataggtttacttaattggcaaagtttcacttaagaaggatgcagaaattctgaacacaagttagcatttctagcacgatggtacaagatgtgttattgaataagtcaaagatgccataaacgcaaatttcaaggaatggcataaggccggggtggtggctcacacctgtaaccctagcactttgggaagctgaggcaggtggatcacctaaggtcagaagttcgagaccagcctgactaacgtggtgaaaccccgtctctactaaaaatacaaaattagctgggcctggtggtgggtgcctgtagtcccagctacaagggaggctgaggcaggagaatcgcttaaacccgggaggcagaggttacagtgagccaagatcgcaccactgcactccagcctgagcaacaagagtgagactctgtctaaataaataaataagtataaaaggatggcacgaatgcaaaactcggtgcacagtgcgctgcagtgccgcctgctgtctgatggaaacatcacaaagacacaagcacagactaagaaaaaaagttttaaaagtcaaagggataggtaagtaaaaaattgaatgcaatatgtaggaaatgctgctttcttatttttatttttattttttatttatttatttatttatttttgagacagagtctctctctgtcgcccaggccagagtgcagtggtgcgatctcggctcactgcaagctctgcctcccgggttcacaccattctcctccctcagcctcccagaaatgctgctttttaaaagtggccactcttatgctaataaagtcatccatgagacaagaacgtgcttaaaatataatagcgcatactgaaagcaatactgctttgtccaagtcagtcccattagtcctggcatgatttctgtagcactcctttcaaataaagaatgtcccaatttgaatgaagaaaactatataatcatcctaatcatgatagcaagattaagtcatcatttgtagtaaaatcttacaacagattgtgactggctgtgtagtgacaaaataattggaaagtggcaaataaaactggtcatagagggtcttagactatatttgttgccttgaagacatgatgggagaattaaacttaataaatgacctcatcctagatgaaatatccttcttagaccaaatatttctgcaaggtatggattgaatcttcataccaagtccaacgaatttttgtcctgctggaaactaattgagaaggaaattaacaggaattaaggtgagatgaacaaggtgagttgcaaaagtgcaggctcagatcctgctaaattttaatatttgctcatggtgacttttttgcattaattttaatatttttaaataatgtattaaaacattatttattttgattgctaagttttgtgcttacccatttaattgtgttcctaaggggagtacctcacttacctcaccttgtaacagattctatacaaggtatacctgggattagatataaagaacaatgaagtcagaactgtgatatgggggtttccactccagctacctgaaactgaggttgccctatcttagtgagttcaaagctggagattctgtaaatagacacggggactgtgaggtccctgcacaaacaggtcatatctgtaaattaaactttgtgattataataattttttttttgagatagagtcttgctctgtcacccaggctggagtgcagtggtgcaatctcagctcacagcaacctccacctgctgggttcaagcaattctcctgcctcagcctccagagtagctgcgattacaggtgcacaccaccacacccggctaattttttaatttttactagagatggggttttgccatgttggccaagctggtcttgaactcctgacctcaggtgatctgcccgccttggctttgagaacaagaacaccatgtctgctggtgtgttagtcgattttgtgttgctataaagaaatatgtgaggctggataatttataaagaaaagaggtttatttggttcacagttctgcaggctgtacaaaaagtgtaatgacagtatcagcttttgctgaggccacaggaagcttacaatcattgcagaaggcaaagtgggagctggtgtatgacatggtaagagagggaacaagagagatgccagactcatttatttatttatttatttatttatttatttatttatttgagacagagtctcactctgtagccccagctggagtgcagtggtgcgatcttggctcactgcaacctctgcctccaaggctcaagcaattcttgtgcctcagcctcccgtgtagctgggactacaggtgcactccaccaggcctggctacttttttgtattttagtagaggtgagctttcaccatgttgcccagggtggtctcgaactcctaagatcaatcaatccgccggcctcagcctctcaaagtgctgggattacagccgtgagccactgtacccggcctagactcctttaaacaaccagcttttgcatgaactaatgcagggaggacttattcgttactatgaggaaggcatcaaaccattcatgaggtctccacccccatgacccaaacacctcccaccagggcctacctccaacatgggaatcacatcttaacatgagatttggaaagaacaaacatccaaactatatatatatatatatatatatttttttttttttttttttttttttttgagatggagtcttgcactctcgcccaggctggagggcagtggcacgatctcggctcactgcaagctccgcctcccgggtttacgccattctcctgcctcagcctcccgagtagctgggactacaggcgccagccaccatgcccggctaatttttgtatttttagtagagatggggtttcaccatgttagccaggatggtctcgatcttctgaccttgtgatcagcccgcctcggcctcccaaagtgctgggaattacaggcgtgagccaccgcgcctggccatctaaactatatcagctggtggtttgccctaagcttttctcccctaagtttcttttttcagaaataaagtttgtctttatctgacgtcagcagattggtgtttgttttgcctgctgtattcctttagtttctaaaatagtccaaattcctcacccttccctgaaaatgttgctcttacgttgacataatgtctagtttcattcagcagttaatattataatatagtactcagattagagtttgcagctgttgtcgttaaatttaggtcattctaaatttacaagttagttgggaagaaaacaaccgcaaattctcaaccctcatcaccatttctgcctctcagtgctcatataaagtcactacagaaaaagaaggaatgcagcaattaaacaagctcatctgtaacacgattaatttttaactctttaattcacttgtttctcataggaaactacattaacatgacaggttgttttttttttgttttttttttttgagacggagtctctctcttctcccaggctggagtgcagtggcgccatctcggctcactgcaagctccgcctcccaggttcacgccattctcttgcctcagcctcctgaatagctgtaattacaggctcctgccaccacgcctggctaattttttgtatttttagtagagacggggtttcaccatgttagccaggatggtcttgatctcctgacctcgtgatccgcccgccttggcctcccaaagtgctgggattacaggcgtgagccaccgcatccagccatgacagtaatttttgaaaatgcattggcacagcaattcaagaagaggaaattggacccatggtctctaaaggacttcccagcaataatgtgctgggctgttcagaattatcactgagaaaaggctatgcccatgtgcacaactgacctgacctcatgtgcacatcagttcacctcaaccaccatcccgtctgctaaaataagtcacattggttgcctcccaaagttctctattcaaaccagtaaactcagttaaataggttgtgaataggaaaatccaaaagtcactgggaaaagatgttataaactaaaatattcatagaaactttttttatgaaagccaaaaaaggaaaaataaacaactaagatgcctaaaaaccaaaaaatggatgaataaaatgtggcagatgcattcagtggaatatcatatagcagtgaaaattaaggacattaattacatgtatcagcatgcctgaatctcaaaaactcaagttgaacaataatagcttttaaaaaatcacagagttaatatgtatgttccaagtctatgaagtcttcaaaaagaggaaaaacaggccaggcacagtggctcatgcctgtaatcccagcactttgggaggccgagatgggcggatcacgaggtcaggagatcaagaccatcctggctaacacggtgaaaccctgtttctactaaaaaaccaaaaaaattagccagacgtggtggcgggcgcctgtagtcccagctactcgggaggctgaggcaggagaatggcatgaactcgggaggtggagcttgcagtgagctgagattgcgccactgcactcccgcctaggcgacaaagcaagactccatctcaaaaaaaaaaaagggaaaaacaaaagagtatattcaaagaatcacaaacaaaaagtaaaggaatgataaacaaaatttaggatagcgtttaccttggggactaataaatatgggtaatgtttaatttattaagctaggagatgggcacatatattttcattcatagaactttttttcctaaatgtatgtgtatgatatatgtcacatgcatgacatatatgtgcatgacatgtgatatatatgtgaactacatatagttcacaaaaactaaatgtagatatggtatacaatcacacaaaagcacttaatgtatcaatgtgtctatatatacatttatgcctaacttatgacaataaatatactctcaaatacctggtcgtcattaaatctaatatgtagaatattaaaatatgaaagaggatgctgtatttgttattagtcatttttctccagtctattttcttttgcatcatttaataaattagtagagaactttcctcccattccttttagtgttttaaaatcttttaatttaaaaattatagctcttagataattgccttatatattgtttttaaattttgtttcctatgggttgctgtaaatctatcctaagtggcaaagttttaaaaacaatatgggtcaaaagtgcacaaagctctgaaaatgagaaaagaaaatgaccaaacctttaagattcctagcattattctgcctatcaccataatgtttgcttggagggaggcaggctatgaactgaacaacctaatttatggctgatgtgctctctggccattatgggcagaatgtgggcttcttcacagcagtggctctcagcatttctcttcatgttctatgggctacagcaagtcacatgaccaatcccaactccattgtgtcagggatgtataatcctcttacttggaggacagcaagtaattgggaacagtaatacaatttggcacacaaaacaaatcttcagagagtgtcagggtcaagagaagcatttgtccgagaaaaagttactctaaacttgcaaaaagataaaaatcataatgcttgattaaaaaaatactgaattattttctaattatttacttgaccctaacctgacaacatttataggagtgatatcaagtcagactatttacagactgtgagtctagaggtcagcagcaaaatttagaaattatcatgactctgtagcccagtggtttactgtcataaaagatatattttataatgaaatagaccaccaagtagaacaacagaccactgaaataaaccatcaaatgacatcctataatttaaaggtatgatgaaaaatggaaagagttgtaaatgtttcttctagagttgtcatttggtgcttctgttagaagggctatggaggaggccgggcgcagcggctgacgcctgtaatcacagcactttgggaggctgaggctggcggatcacgaggtcaggagatagaaaccatcctggctaacacggtgaaaccctgccactactaaaaatacaaaaaaatcagccgggtgtggtggcaggcgcctgtagtcccagccactcgggaggctgaggcaggagaaaggcgtgaacccgggaggtggagcttgcagtgagccaagatcgcgccactgcactctagcctgggcgacagagcgagactccatctcaaaaaaaaaaaagaaaaaaaaaaaagtttgacacagtttgatctttttctaacacctggtggcatttttacagcataacctttaaaaagtcattctagaatatcctaatagatgtatacatccctctacctaaatttttgtagatgttatttgcctacatagtgaatgatattgtatttcagcggaatttattattcaacttttaaaaacaaatctcctgcatttacatccattttccatatatctatgtcataaagataatgaatttaattggacaattttctttcaaatgtgtgcagcctccttccacttccaggtctgaaagaggacagtatattttatagaccacacgattgccagagtggaaactggagtgagtggaagattccacatagttttacttgtgatactctagagactagtggtgaggtgtcttggagatggcataataatacaaataactaaatattactgagttgttactgtatatggcactatgttaaaggtttcataggcatcactcctcatcacaacaataatagcccacctcggcctcccaaagtgtctgtcccttctttattcaccagccacaatgacacacagaacatagtaggaagaaaatagtttatatttattcctaagaatataaacttctgttaccattctaaatttccagaaaaacttattgtgagtgctaaactaatatcatcctgacctaagacaaattgtcagttcctaagggtgagatttataggagaaaaccatgtctacgcttgaggcagagttcttagtagagatacaatagccagttgctattatttcaaagtttgtctgtccctaaatattgcctgcttaggtctgactatgctaggattagtgatcatctgctctgaattaaaggtttagatgcgctcttcccaggataaaattaagtttggggactttctcttttcctgggagcaaaaacctcaggaactaagtgccatatgctggaagatggaaacattccaacagccagaagtagagggaagataaaaatggcttccctaaagcaaggcaaatcagcgacagccagtcctgtggccaccactaatcacttgtaaatgaatgctgcgatgtgtttcaaaagccctcattctgactctgcctgatctgctactgaaatgttaattatatgcctaatcttctcttgcaagcaaaggcagcagagttgctaaagatcatagcaggtaaaagccttcaaggagaggtaaggagtaaatggagctgggagagaatgctgtctctcaggacagagcctggctcattgaaagggcatagtcctaccctataagggatgcctcccagtgtgaccaggtcttctatgatttctttttatgagaaaccagaaatctgattatgttcatgagaaattggagttttacaaattagcaaaactgtgctgtgctgagaaaatagaataaacctgaaggccagaggtgtgctgggagagtcacttacagaaccagagcaaatacttagatagagcaatgatgtgttttaataaaaacagggactactgtgctttgtaaatgtctttatgccttctaaacgtcctttctcctgaagtctataacgtgacatgggatagcaaagtattttttggcatgaaccattgcattgaatatcttaacccatttgtgttgctattaaaaaaactcctgagactaaaaaatgtatttaaaaaagaggtttatttggctcatgattctgcagcccatacaggaagaatggcagcagcatctgctcagcttctggtgaatttctcatgttgcttccacacatggcggaaggcaaagggaagccagcatgtagtgagatcacatagtgagaaaagaggaaagaggggggagggggtgctaggctctttgtaacaactagctttcttgggaactaacagagagctcattcatcccctctccccagggagggcaagaatcttttcatgagggatctgctcccaagaccctaacacctcccattaggccccacctccaacacaggggttcaaatttcaacatgaggtttaggagacaaacatccaggctatgtcattggatccctaataggctgaagtaatgtgttaaaaataagttgtaaataattatatgcaaaaacacatagcattttggaaactttgcaagataatgaaaatatttatctggattttaacttaattcactccatattctacacaaacatatttttaaaagataatacaatatttgagacattaatatatgttaaccaatttacatcctcaagagctaagaaagtgttaagttgccctttcttaataaaaacaaaatttatgatgttaactgttttttgtttgtttgtttgttttattgagacagagtcttgccctgttgcccaggctgtagtgatcatggctcactgcagccttgacctcctgggctcaagtgattcttccacctcagtctttggagtagctgggattacaggcgcatgccaacatatctggttattttttgtagaagctttgtttcaccatgttgcccaggctggtctcaaactcctgggttaaagcaatctgcctgccttgaccttccaaagtgctgggattttaggtgtgagccactgtgcctggcctatgacgataacttttttaaaagacaaaattagaacaaatttagttatagatgtaattggcttctatttgtaagtcatgaatcagggcagcctgcattctacaaaataggatgagagcttccacagacaatggaagaacagtagcttctgtaaaatgagaacaattaaacaaaacaatagacaaaaagctgattggttaagatcagggttaatccaggttaatttgttgtaagggttaaagcagagaaaagttcctttttgcactgactcaggtagaccggaatttcctgtcttgaggaaaaactgctctgttctgggacctgtgtactttcttaaagtttcagtttgattatgtggtttaacatagcacatgaataacaatgcgattattttaaaagagttattataataaattttgataaatttgctcaaagtcattatctctaataatcaaattatctcaaatttaattaattgcagtatgtgtcatttatttcaaaagtgaaataaaaacctgttccacaaatcacagtttagtttattttcaaattcaaactttacttgcttcactgaatctagcaaaagtaaatgtttcaaaataatgcaaaaaaaaaagaggtttgtaaagttggtaagaaaatatttgctgagcaagtaatcagatgtttattgtcttacctatgtcatttcttatatatttacattcacattgatttgtattagctatcaagttaatcatgttaaaaaaagtggtaccataatgaattgtgtttgatgttgaaattaatatttaaagatttaaaaattatgagagagtattctgtgttatctcagaatactggtaatgtcttaaagatttctggctacaaagtagttttacaagacattagttttatgggcactgcatgcattgcattgatcaaagcagcattgcattggtatttaacactaggccatgactgaaagggcttcagaagacatcatgatgaactacatacagagtaatggcaagtttactataaaattaacattctcagttgtcacaagaaatctgacaatcactaaaatggcaagcactgtgttctatttgtgtccttttcagacatgattgataagaatttgttaccttattagcatgtcataagtagacagcaaagtatgttttaaattcgaaaattattattttctgctcacgttctactttcagcaatgtacacagtgatagtaatgaaagcagccatcagaatagtctattttcttcatagttagctgccaaatacttctttttttctatccagatcatacttgtattgcttttgtgcctttgagcatagtcataaattagtacacagaggaagcagggcagtgacagctatacatttttctatagaagatcagctattaaatcaagaaccaagagaaccatctcagcctggacactgagaaccgaagccacaccttcccactgatattaacatgactttgttattctattgttccattagtattacttttcgaggactgtcctacctaaagaatggtttgatttttcattataggaacttcccaaatgctttatcaaccttcaggggaagtcatagaccgagtttacagcttgagtctttgaatccttccccacaaatcctcacctcactattttctctaagcccagactgttgtatcatgattctcacacaattctaatcaaatcctctccttcagagacccatcttaaaccaaacttgcaattctcaataaattctgatctccccttctctcctctgagatgctgatagaaatttacaaaggctgtactctctcccttgccagtgtattagttttctattgctgctgtaacaaattaccacaaacagtgttgtaaacaatccagacttgttatcctacagtcctcttggtcagacattcaatgtgggtctcactgacctaaaatccaggcatcagcagggtagaggttcctcatgcaggctctgggctcctgtgtctgacttttccagcatctagaggctgcctgctgtcctcagcccctggccccttcctccatcttcacagtcagcaatgataggctgggaggccttctcacgctgccatctctttggttctttctcttctgcccccctcttccacttttaagaacttgtgattagccccatctggataatccaggataatctccctatttcaaagtgagttaacaactttaattccaaatgtggtcttaatttccatttttcatgtaagttcacatgttcacatattccagagatgagtgtgtggacatctttgggaggtcaattattttcctgccacataggtaagcaataaacttcgcaataagccgggtgctgcggctcatgcctataatcccagcactttgggaggctgaggcaggtggatcacctgaggtcaggagttcaagactagcctggccaacatggtgaaaccccacctctactaaaactacaaaaaattagttcggcatgatgtcacatgcctgtaatcccagctactcaggaggctgagacaggagaatcgcttgaacctgggaggcagaggttgcagtgagccaagactgcgccactgcgctccagcctaggcgacaagagcgaaacttcatctcaaaaaaacaaaaaaactttgcaataaataagcaatcaactttgtctcatcaacatgttatgttggtgataattggggatacagctttgacaagcaattagcacaaacatgacctacttgcagaaacttgtcatagctattattctaaatatggtaatagatgactgtaataatccaagccaagaattatgacattttaaatccacacacactcttactcctggaatatcctcaaatggacattaacatacaaatattttaattagattcttttaaattcttaagattatgtgatataacccaaaagtggggctgaaatgtcaggtgacaataacacccaaatggaggttccactcagcacctccagggacaccccccccaacatatatacactctttacagaaacatatttggaaatgaattcattattcataagtagttgtgaatagttagaaaatagattttacatttcacattcaataaaactcccacagaatgtcaattctgattattcgtggattttgtattttcaaatccaccttcttgctaaaatgtatttgtatttgcaaattcacccacctgctaaaatttattactaaccccaaaattcacactcacagcacctttgttgtcatacacagactggccaaaaatttcattctcccagcttgcacattcccagctgatgttgaacaaaaccgtgttctgccttcttgtttcaactctcatactaaaatcaagtgtccttttcacaatctgtttagtgtcgtggttttcatatttttgtgcttttttggtgattttgatgtttacaatggcccccaaacatagtgctaaagtgctctcaaagcacaaaaagaccgtgatgtgcattatggaggcacatgtgacataaactttgttcagatatgacctatagtatagtgccattggctataatctcaatgctgatgaataaattttatatgttaaataaggagtctttaaacagaaacacatataaaacaagattatgtcttgatcatttgatgaaaatgttgcagccagaggctcacagaaacttccccttacattttcccaagaagcaacaatttaatacttgctaatgttggagctctgaaaaccatatcctcaaaaatggcactttgacatgttgagtgctttgaattaaataaaattgaaaggcctcagaaataagcctcaggaccaacactctgtctaacaccatcagcccccccaaccccaccctactgtattagtctgttctcatgctgctgataaagacatacccaagactgagtaattgataaagaaaaagaggtttaatggactcacagttccacatggccggcgaggcctcacaatcacagtggaaggcaaaaggcacaccttacatggcagcaaacaagaaagaatgagaaccaagtgaaagaggtttccccttataaaaacatcagctctcataagacttattctgttccaggagaacaatatggggatatggggggaacagcctccatgactcaattatttcctactgggtccttcccacaacatgtgggaattatgggagctacaattcaagatgagatttgtgtggggacgtagccaaaccatatcacctaccatcctctttctttcctgaagcaaggaagcaagaaaggagaggcttttgctgaagtttccttatctgattaagtctgaccaagggaggtttctccagaagaaatgcagtgtttttgtttgtttgtttgttttaatttagcccagtcaaattgacatatacaaatgcagggtttttttgtttgtttgtttttgttttttgagacggaatctctctctgtcacccaggctggaatgcagtggcgtgatcttagctcactgcaacctttgcctcctggattcaagcaattctcctgcctcagcctcccaagtagctgggattacaggcatgtaccaccatgcccggctaatttttttgtatttttagtagagacaaggtttcaccatattggccaggctggcctcgaactcctgaccttgtgatccacccacctcgacctcccaaagtgctgggattacaggcatgagccactgtgcccggcctgtttttttttttttttttttgagacggagtctcgctctgtcacccaggctggagtgcagtggcgcaatctcagctcactgcaagctccacctcccagattcacaccattctcctgcctcagcctcccgagtagctaggattacaggtgcccgtcaccacgcccggctaattttttggtattttttaggggagacagggttttaccgtgttagccaggatggtctcgatctcctgacctcgtgatccaccctcctcggccttcccagagtgctgggattacaggcgtgagccactgcaccgggccagaagtgcagatgttttaaaactccctctctacagatcttatcatataaccaggaaagagtaaccaccagagaggagaaaataagtcattaccatgtccagacagacttttcatctatccttctgagggcagctcagagagattatgggaaagattttatctgcataatgacaacctttgtttacaatgaagttctggtctcacctttccataatttgcttgtacctcccccagagctcagacgaactttgtaccaggccaattgtcttttttttgagctcattcattttccctaaaataatttactttccctctagatgtgcccacagtcccccttttccctgtcccctgtgaataggatatttaagaattaaccaactagagggcatttaaggcttaaccaaagctcttctttgagtctcatatttttaggactcccatctccatgtgcatattaataaattgcatgcatttttcccttgttaatctgtctattgtcagctcatttcagcagtgaactatcagagggcagaggggaagatttctctctgcccccacagtaatttgatatttacagaaactttatagaacataactactgtgaataatgagaatcaactgtatatgtcacctttgaatacctctcttctctcttcactgcattcctttggcacagagatggagccaaactctagtggctagggaagtgaataaaagactgggtctgagtcacctgtttccctaaaggtagcatcaccctctgaaggtgccccttacaggcctctctgggaagggtttcacaatctccttccacactttacaggtggcaaattatggagccaagggccaaatccagtgcccatttgggcaacaagctaagaatgttttttacattaatgacaggctggggaaaaaaaaaaaaacagcaaagaaaataatatgacctaaaactgtatgtgacacataaagcctaaatatttactatctgggcctttacagaaaaagcttgctgaccccttctttgcagcctcaagtatagcaaatatctagtgtttgggaaataatttaaaacaaaacctgttcaggaaacctctccacaaaagtagaatagatgttgttgaataagcactaaagctcacttcaatgtgcatcacaagaaatctgccaaagagattgaaaaacagacagaaatctcaccctttcatgtggccaagtaggtaaaaccctcacatacacgttctcaagatcgatgataagtagtttgcaagtaagtaaaaggacttgacagcaccacttgccacatagagttcatcccagattcactgggtaattgaaattggccatgggtgcttgctaattacctttatcgaaaggaaaaacaaattctcatatctttataccaggaggtagttttgcaatgtggagcccgacgcctaggtaacattaggttcctaccctcccatgaaaatgtcaataaaaagagtccaactttgtaacacatttgtagaaatttattctgagccaaatatgagtgaccatggcccatgacacagccctcaggagatcccgagaacatgtgtccaaggtggttgcagcacagcctagttttatacatttcagggagacatgagacatcaatcaaatacatttaagatataagttggttcagtccagaaaagtgggacaactcaaagcaagggggtgtctgggttataggtagaatgaaaaatttcagattggcaattgcttgaaagagttattatcatagaaaacaatgtctgggttatgataagaggttgcagagaccaaagttttatcatgaagatgaagcctccatttcgcaggcttcagagaaaatagattgtacaggtttcttctcagacctaaggcttgtgttgatgttaaatggtgattggcttttcctgaattccaagaggaaagagggcataatgaggcatatctgaccctccctccccattgttgtgggacttttccttagttcagctaaagatgcagtctttgtcccatggccacgaaaatttaggcttgcagacgagttgaagggtgagtaaagcagggttttattgggtgaaaaggaaaaaaaagggggaacagggaccctctgcaaagtcagagtctctgctggtgtgcttcctgccttgcagattgaatcccagtttccacacaggaagaggtgggaccaggctcctccctctgcaaacagtgcaaacttctgtggctccaccccaaggtgcattccttccagtgtgggctggttgcagtttcactggggaccctctcccacctggctgtctcaccatcatggcctaaaccagtctttcaggttaaatttagggtgccctggcagaggaggggtccattcagatgtttgtgaggggtggagggggtggctatgagttttatttttggtttataaagatgaggggatgaggtacaatcctccttggtgattctatctcagagatagttccagacccttgagaaacacattcctacattgtaaaacctgcaagagacttatcttttttctttaaaaaattgctatatccctaagaagcagagaaagaatttatgtttctgaaagaaaatattctgaggaaatggtggtggtggtggtggagatctctttccctttttccatcagggagaattattatttttttcctatgttccatttgtatttactgttacactagttaactaagtatctagccaaaaggaactataatttgagaaggtggttcccatgacttctcctctttcttttctttcagacttctgcttcctcagaaatgccctcattttgtcccaaggtactcagatctgtcactctacttgaatccaatcagcaaaacaacagctctgcagttagctgacttgcttctaacctccatcatctaaagtagaatattaacctcttatatcgttattcaaaattgtcacctggggtttcagctcctattctaacaggtcaatagaagcatttcctgaagagaaacaggagtgtgtgtgttttgggagtacggaagatatttctactaagaaaaggagtttttctccacagtgttaacattagaaatctagcacctatcatttcacaaattgaatacctgaggcttagggaggtgaagtgacttccttgaaggaaacaagtagcaaatgtggaggttcatgtctgcagcctatagaacccaggaaccctctttccactatgccagactaacctgggaacccaattagctgccatcaaaagtataagaattctttttatttgcctattatctctcatgataagtgaatcaattacttactgagcacaattcctacaaagtgcaaaatgaccaaagtccccagagtagcttcctctacatcgtgagctgcaactccagtaaaagaggctggcaactctcaaagacaaaatgcactggactgtggagcatatgatttcattaggactatttgtaatagagagaacatggccagatctcagcaggttgtgactgtttaactggtggtataatttactatcaaaattattctgcaatcgggggggtcttagtcaactcaacaggaaatgtttatcttaggattttgttagttcggagggacaaacagttctaatcttagctgattaataatgagacaaagaatgggtggttggaggatctgtgttttgccttgtcagcagacttaggccaaaggggaaaggtctgtgtttgatcttgtcaacagcaatgtgctaattgtgactcctaatggggatggagcttggtgtgtgcttggacatggcattccatatgtgcccaggacatgctgtctttttaagagaaaataagaatctgaccaggcacggtggctcatgcctgtaatcccagcactttgggaggccgaggtgagcagatcacgaagtcaggagattgagaccatcctggctaacgtggtgaaaccctgtctctactaaaaatacaaaaaaattagccaggcgtggtggcgggtgcctgtagtcccagctactcgggaggctgaggcagaagaatggcgtgaacccaggaggcagagcttgcagtgagccaagatcgcgccactgcactccagcctgggcaacagagtgagactccatctcaaaaaaaaaaaaaaaaagagaaaataagaatttaatttcttcagggatcctgagtatctctcattacctaaagtgttcatttattaccaaatgattaactttctatttatgtgtgaggtttgtgggagaccatagagaagttttgtttaaaacatctacgtatttctttacataattcatttattatatcccttgttgaatgttctggctgagaaagatttaatttaagctttccatcaatgagaacaaagatgaggcttgctgaaatatgttgatgttcactggacagcaaatatcctgctctgttctatattcaaagttgaaaagtgatggaaacctcatcctcatcctcagggctcagaaaagtcacaaggtctttgactttgaagagtggaacaagagggcaacatgttttctagtaagtaaagtaagtgaggctatggagtaggtttcagagtggcactttcaatcttactcggacatgtcaaagtctttacaaaggcttcttctagacctgtaagcctagaattaatataaacgctcacctaggtcaaattcaatgatatttatcttaaaggactttcaaatctaagtgggtttcaataaggcaaacccttctgagtcttttatttccctaagcataaaattctatcttctctaccttctgtacttctcagcattagcaaaggaatctcatgataattgaattcaatagtagtttatctgatgccaactattttcccgtctctatgctgggccctgggtacacaacaatgaaaacaatgtcctcctctccactacccaggctgccttctcctctaaattgaacaattgtctgtgattcaccaacaacaagaacttttctttacttacctacctaaaatatataaacacaattgacaactttaggcatgttctttcaattggaggacaattacaaatagttgtcctttgtattgatgaaaaggctagtggcaaggttggttgtggcctgggcagcaggctagatgggcctctcaggaggacttgctaggttgcagtgccccagagcaatttatgacataaaatctgtaatatttgagagataattgtcacatcttataatcaagatcaaataactgggttctccttttgtctgcaaatgatgattgtgcttgcccacagtgaagccgacctgcgtgtcaaggagctcgatgaggatggaatcccagtgctggctgccagggtgagggtcattttggttgcaggcgagggtgatagaatgttaccaaaaagagaggaaaaacaaactttcaattatgacaagtgcaaaaaaactttttattttgaggtttagcatttctcaaaataattacagttacatgcttccatactacatacttctctctcaaagattagttggttggatttatctagggcttgaacacaatatcctatcaaccttgtaatcctttacatatcatttatattgcttttactcatttagctcagtttccattgaaatgttacctttgctcattattgttacctctgaatgtcctgtccttgtttttatgagaacggtgtctagctatgttgttacattagaactatataaagagcattaaaagatgtacttatttcacaaattgtcaaaatataaacaaaatataaagcaaaagacaatagagatatataaacatagcccttaagagctgtagatacactctttttttgccaaagatttctattttttattgtagatttggagcgggggtacatgtgcaggtttgctacaaggatgtattgcgttatgctgaggtttgggtttcaactgaacccatcacccaaatagtgaacatagtacccgataggtagtttttcaccctttgccccttccctcttttctgtccttcagattctccagaatctattgttctcatctttgtgtacatgtgtacctaatgtttagcttccacttgtaggtaagaacatgtgatataaatatactcttaaattgttcaaagataacgaatgcatcaaaaatatttccaaatgccttgcctgagagttttatctgagtgaaaagagttttccttttattaatcccaggttgatatgagctccactttgttctctgtggagtaaaatcctatctctctgaggtttttgtttttaacaattctcattgatttttattgtgcatataaaaatgaaatcatttaagaagattcataatgacaagatatctgtagggtaaacccagaaagggttcaagctttatgacagcaaaggaaacaattaatagattgaaaaggcaacctataaaataggagaaaatatttgcaaactatttatctaataaggtgttaatatccaacatatataaggaaaccctacaactgaatagccagaaacaaatacccagatttttaaaagatgtacagtacttggattgacatttctctaaaagaatatctgagtagccaacacacatatgaaaaatgctcaatgtcactaatcagagaaatgtcaatcaaaaccataatgagatatcactccccactggttgtcaaaacaacaacaaaaagataacaagtgttagcaaagatgtggagaaattggaatccttgtactctattgggagtgtaaaatggtgcagccactatagaaaacagtatggaggctcctcaaaaacattaaaaatagaactatcgtatgatccagcaatcccacacttggtatttattcaaaaaattaagatcttgaagacatattcgaactctcatgttcattgcagcagtactcacgatagccaggatgtagaagccgcataaagacccaccgacatatgaatagataaggaaaatgtggcatctacttacaacaaaatattattgtctgaaatgaaatccttccatatgtggcaacatggatgaaccttgatgacgttatgctaagcgaaataagccaaaaggaaaatacagtgtgagtccgttattatatgtccaatataaaataaccccattcacagaagcacaaagtgcagtgggttaccaggggctgggagaagtggaaaatagggagttactgtttaacaggtataaagcttcaggtatgcaagatgaataagtcctagagatctgctatgtacaacattgtgcctgtagttaagaacactgtgttgtattcctaaaaatttaagagggtagctctcatgctgtttttatcccaatttttaaaaattagattgcatggaaaagaagatccttgcacatggacttttcctctttccataatttcaaattgcaagcaaattaatctgggatgatgacttatatttctcctcaactataattttacttctgcctcaggaggatctcctatgaatttctgataacctagttttcctgtgcttctccactcacaggttgtcctaaaatcctagttaatttacatgcttgaaattgcttgcatggttttttttttctttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggccgcttgcatggtttttaaatttcaaataaataatacctttgattggactcatgggcttctgatcaaacccacagactttctttcatcaaaactaaacacttcagtagatcctagaaaaacagtgaaaactctccaagtataaatatgatgctgaataaggtgtttaaaatatatgaagctttacacatacacatacatttttagtatgagggtatctctggcctattcacttaaggaaaaacataccaccagaaatggaattccctttcagtatcagaggttaatatgttaaatcccattgttagctgacatttttctaaaatataccaactagaagtttgtctcataccctactctttactgctcctatcttacacgtatcattatgaaaacaaataaatgtccattttgtttccttttgtaaaaacatatgataatcaaaacatttggtcaacgtctactccatctttgtgtttatttaaagacaacttttatgaaatgataatattggaaagttatgatatccttccagctagttgcaaagactaaagaaaatatgctactcaaggtaaatgatttgtaacccctgagcagagtcacagtctccctctctctctctgtctctctctgtctctctctctcacacacacacacacaccacacacacacacacacacacattttagaatcttcaaaaaccacttccaatacaaactaggtacctgaagtaaagagatactcattttggctgaataagaggcaaattcattttgtgtttttcaacttatttttagagaaagctttgaaatgacattacaagtcatgtcttttgcagccctgtcataaccatgtcactgtactttcagcttctcaattccttggcaagtcacatgcattgtcatgttgaatatcagtattttaaaagaatagctgtcaacatcagtggcatcctgaaaaagatgtacagagaagctcatattacccagaaaaatctcacattgtctttcatacttcagaaataaaaagggaaaaggaaaggtaattgtcctttaaacatacatttatatagatgccagagaaaccaaataaaataggaagctatttttcaactgacatgttctaagtcaatataatggcattacatattttctcaatttgtttaatttgattttaaaagtcacaaacatttgaatctacgggtatgaatttcattcacattatatataatgtaaaatatttactttcatgattttaaaaatcttgtctattttgtgtagttttcttttgaaaatgtaatgtgttttctcacatcttgttaatgtacttctaaaaattcatttaccgagtacacaatgagtaagcatcaaattacatctaaataatctgttgattgggcagtttctcctcatacactacagaacaattaggcacaatagaaaaaatctctatgtcaaatataagtgattttaaaagtgattattaatcataataacataagaacaattggagcagggccttcaatattgtcacatttatgacagtacagttatctttgtgttacaagtatcttaaataagaacagtaaggttttattttatatgagaactattgttacaatttagctaattataaaaagtttgctttgagatatagtctagattattttggtatgttcttttctctttttcattttggctagtattactgttagattgtaacagcaatatttatcctccatggcatataacatctgccatttcagtcttccgaagtgatgttgttggggttcagaacacaatactccaacagatggcacctcggcctgctgaatactttgaactaaaggagattggaggcttcagaatcaagggcaaggtcgctgaccttctcctaccctcctgtctccctcccctctcattactctgaagctgaaaccagaattccttttccccaaggcaagtcacagaaactagagcccctcttccccaaagcaagtcataaaacctagaaaagtcattcttttccttctcccttgaagactgtgtgtcccacagcaggagaaataaatgcagcttagaggccaggaagacaggtcttgctgggttctttctcagcctattaccatgagatcattcctttttgtccaattacatttccacatggctgtcccttcttcatgaagcctacctataaaaatagatgatttccctgggtctttggttcttcatttttgaaagctcttctgatatgtaaaactttgattaaattgatttgctatacttttctttaaactgccttttgttataggagtactggttgtgacctttctgatggggaactttggaaaggtatcacccctttctgcccttactgtataaagagtaaacaggtagttgagacacagaacaatatcataaaatttcttttgtcctttagacaaggccttggctttttctccattgcgattttgatggactgcaaataaaaatggaaacttatttcatatattttaacataagactggccgggcgcggtggctcacgcctgtaatcccagcactttgggaggccgaggtgggcggatcacgaggtcaggagatcgagaccatcctggctaacatggtgaaaccctgtctctactaaaaatacaaaaaattagccgggcgtggtggcgggctcctgtagtcccagctactcgggaggctgaggcaggagaatggcgtgaacccgggaggtggagcttgcagtgagcggagatcgcgccactgcactccagcctgggcgacagagcgagactctgtctcaaaaacaaaaacaaaacaaaacaaaacaaaacaaaaaaacaaaaaaaacacataagactatccaaccatttctagactaaaagcagtgatcatgaagcagattctgctaatcggctgtttctatttcattagaattttttgcatggttaactgagattgtaactgtaattttattttttgtatttaatcttttaaaagtaatttagctttaatgttgtactcatttcataaaatgaattagaaagcttttatcagttttcaattcttcggaacagtatagactgcactggaattaacttctctttaaaggagcgatacaattctcttagaaagtagtggccacctaatattctgaaggactgacatttttctttgtcttttgcatggaagtcagtcaatttagacttttctaatttttataggattcattttgttaaattatattttcttggaaaatcatatactttattaggattatcaaactaatttgaataactaagctaaatagattcttacaattcttttaatttcctcattagctcttcttttttctgtttttgttttgttttgttttgtttgtttgtttgttttgagatggagtctccctcttgtcacccaggctggagtaccgtggcccgatcttggctcactgcgacctccacctcctgggttcaagcgactctcctgcctcagcctcccgagtagctggaattacaggcacccgccaccacgcccagctaatttttgtatttttagtagagatggggtttcatcatgttggccaggctggtctcgaactcctgacctcaggtgatccgccctcctcagcctcccaaagtgctgggattacagtcatgagccactgcgcccggcccggcctggaaatcttatctaaaaagtagcaactgctggaaaaagggcctggggcctggggggcgggggtggttcttgtcacagcccccaggctcctgtctcagggatgaatgtggccttctcactgggattcttctcttgtccaaaagggctgcttttggggactaacaatactggggagtgggggtgaagccagacctagctcagggtgaggatttcggggccctggcgtactgaacacaccccacaccccaacattctcctccttctatctcttcctcttctcccgaccgcttttgtgccggggctgcgagctccctgtgttgtgcggtgactaaatcgaggccgagaagggaggctgccccccaaccctgtgggtcagtgcccctctgccaggctaggagaaagtgggtttacagcagccgagctgggggttattttggctggagctgctggagcagaaaggcaggagtctgaaatgctcggcagggtctggggaccttgttggacccgcctggtgaccggctgggctgtcgcgtcctacacgggagctccgggctttcatttctcttgtggtggggtggggattaactcacctattcccatggtaagcctgggtctctaattgggccctgggagccctgttaggccaccggcattggaggtcggtgaggaaggggactccccaactcccccgactcccaaccgccccacctccgcatagccttggagacacctgggggaaggggctggggggcttctgagcccctgagtctaggttcactctcccgtcgggctgtgggaggggactttcacttgcctttgtctttggggacgggaccccactttcttctgatctcagggccattgacacacaccccctttccaggaggggttggtgggcagctaggttctccctgccccttcccggggccggcaccgtagcagcacaatcaccccgggaagggggtgtcttttcgctccaagacgcaatcgggccccactcgcagaaccgcctggaccctgtccgtgtctgccctccggcccccagggctcctctccccagagccgccgtcccgcgcctgggtcccacgctgggggaagcgcctgctgcttatctctgtctacctcaggtctgacttttgatgccaaaatctaagcccctggggtgcctctcccccgcctcccgtgcaccagggtctgcagcagccactggggccaggctgcctgctgcatctggcggccctggaggcggccatgggcccctttgcacccgcccgcctcggtgtctggggaggggctgcgcagggccgtgggctgggtcgtctctctcgggctgcgtgtgttgcgctcccgtgtgcacgtgtgtgtgtcgggaatcctgcgtgtcgtgcctgtgtgggcgatccggccccctggctgtgggtgggactggattctaactcaggggacttgggcctgctgttaacttcgatgattgtagggacaggtggggcgggcggtgggtgggcacggggctgggtcctgggcggcctggcgactccaggagaaggaaatcactgaaggcagtggtcgtggaaatgggagggggtcgcagggggtctgtggggcccggtcctggatactgggcaggaagccgtggtctccagagggtactccctgcctcaggtggccccattcaaccccagccgtacgcacctcccgccactgcctgtcggtgggggtttaaagttggggtggctttctggggtgcagctcagcatcccctcttatgcagactgggatggggtcgggcacctccctcagccacgaggaccctggacgggttcgagttctcttggggccgtggggctagctgtgtactgggcggggaccccacactcgaggccgagcgggggctctccctgctctgagatgttgggggacaggcagcttctggaaccttcagtgggacccttaagtggccgtcaggacaggcgggaggatgggcatggggcactggggagagccggggtcgttaagggtcacgcatctgtacagtctgaatttcctttatcttttttttttttttacccactttgtccctcttttcccctaattgtgctcttgcatttttttttcttggcaaacgtaaactcagcctttcattatgacgtgtgacatttcagtttctctggggtttgtcagaggacgcggggaccacgcctgaaagttaggtaatgggagaaaaaaaataatagactttaaaaaaataaaaaataaaagaatcataaaactactctctacctctggctgggcccagcctttcttgccctggccgcagcagggtggcctgtaacaatttcagttttgcagaacattcaggtattaaaaggaaaaaaaataaaaaaagacaaaaagaccagaaaaaaggtgtgattttgaaatttaaaagaacactgaaagtttacattttataatagcattattatgcagattgtattttaacttcagaaatatttaagacgattgtaaccctgtaaagctgataagatattaaaacgagacaaaacactttttttaacaggaaaaaaaaaaagaaagaaatttcttctgtcagataacctaaatcatctctctcaagttcaaagttccacaaatctctagggcaggggcaaaatgctgccagtctctttgctaaaacataacaagagtcacttttgctccagttcccaacaagttgctcatctccatctgagaccacctcagcctggcccttattgttcatatcactatcagctttttttgtcaaagccattcaacaaatctctgggaagtttcaaactttcccacattttcctgtcttcttctgagccctctaaactgttccaacctctgccttttacccagttccaaaattgcttctgcatttttgggtgtcttttcagcagcactccactctactggtactaatttactgtattagtctgttttcacgctgcttataaagacatacccaagactgggcaatttacaaaagaaaggtttattggacttaacagtttcatgtggctggggaagccttgcaaccctggcagaaggcaaggaggagcaagtcacgtcttacgtggatggcagcaggcaaaaagacagagagcttgtgctttattttaatttttgttgtgcatatatgtgtatgtatgtatttatttttttttattttaagttctgggatacatgtgcagaacatgcagtttcgttacataggtatacatgtctcatgatgttttgcttcacctatcaacctgtcatctaggtttttaagccctgcatgcattaggtatttattctaatgctctccctcccctttcccccaaccacgacaggccctggtgtgtgatgttcccctccctgtgtccatgaggaactcctctttttaaaaccatcagatagtgtaagacttattcactatcacgataacagcctgggaaagatttgcccccatgattcaattacctcccaccaggtctctcccacaaaatatgggaattcaagatgagatttcggtggggacacagccaaaccatatcaagtccctagagtgagtaggtgggtggagcttataattactggattggaagctcatcaatatcttttaagatttatatgccataatttgtccagcatctgagtactttgtagcatgaaatgcttcatgttacaatgaagtattagtctcacatattataggcgctgtcttcattttctgttgctgcataatgaattaccacaaattctgctgcttaaaataatacgaatctattatctcacagttttagttgcctgggcacaacaatttaggcgttgtctgaggtaacttagggtttctgagtcatattcctcattttcttctgtctttcttccactgcctaattatgaagccactcctagtctcaattataaaatctgtctttgttttctgttgctgtactgccaattactacaaatttagcaggttccaactaagccatttataaattcatagttttgtaggatagaaatctggtgtggtgaggccagttgcagtggctcacacctgtaatcctagcaatttgggaggccaaggcgggtggatctcctgaggtcaggagttcaagaccagcctggccaaagtggtgaaaccctatctctactaaaaatacaaaaatcagctgggcgtggtggcgggtgcctgtaatcccaggtacttgggaggctgaggtaggagaattgcatgaacccaggaggcggaggttgcagtgagctgagatcgtgccattgcactccagcctgggcaacaagagtgaaactctgtctcaaaaaaaaaaaaaaaagaaaaagaaaaaaaaaagaaatctggtgtcgcttgcttgggttctctgctcatcatctcacaaatctgaaatcaaactgctgtgggctgttttcatctggaggactgagcaaggaagaatctgcttccagcttatcagcacaattgagagaatccaattccttgtggttgtaggactgggatcctgtttgctcactggctgtccactgaggccactgtcacatcctagaggatactgtattccttcaaaactgcaatagcatgtcaaattcttcttgtgttttgaatctctgacttccttttctgacatcagctggagaaaattttctgctttgtaaggactcatatgattagaaaaatctccccatgttagggtccatccagataatctccttatcaatgaatcaggaccttaattacatctgcaaaatctcttcacagcagtatctatatcagtgtttgaaaaactgggagtaggtgtgtatacaatagggtaaaaaatattggccatgggcagtgggaggaggtatcttataattctgtctactataaacatgttgtttcctaaaattttctcttgagttgatttaatactatattattttattttgagggggacaaaagatatataaagtattacaaatattaatttactcaatgtaaatttggagtgccattaattgttcctcatggcctaaaaggcttaaagccctgataataatctcattataataaacaactttgcaatacactgaattggtccactgacctttgtttcaattcatatgtcttcaaaaattcatccctcaatgtaaacaatcataatagtctcgacagtccagagaaatggtgtaaatggtgtacaaacttcaagaagagctgtgtgtgtctttgtgtgtgtttgtgtgtgatcacaaaacctagatatatgttaacatgaaatattatggaagaaaattaatttaaggaagtgaggtggaaatgcaaacacagaaaccaaaagatggaactgtccccacaaattttagaaatagattgtgttccaaacatcaaataaaatcaagccatagaaaggaagaaaatcttaaatacacaagtaaaatttgctgtttttctctcagtctctatttattttgttttccacatgctttaagttgatcattgtttcctttactcagcaatgcagaagagatgagtgataggaagaaattaccatggcaaatcatgaatagactgataacagctagtgactactttgcaagtagttatttgaaactacttgcaaagtagaccgggtaaaaatttatataacaaaatgcaaaaattgagtaattaaccgctgagttataagaatttgacttaaccctgataattcctgttgaacaaggacattgcgtgttcttctattaattccttaatcacgacttgtaggttgaaaatgagaaatgcttcttcttgatagataaagcactgatcttatagcaacaagaggaaagaactatgggccaaattttcttagctatgcttgaagtaaactttgacaactaatcactttttattttatttaagaattcccaaccaggagtaaaagtccaaacctgacttataaggcatataatttaaaaaataatactgtgaaataacttaatacaaataacaaaatgttgaaggtaggcatgttaaatccacattatcagattgggttttaaagagaaggagaggagacatcaagcatttagaaatcaataggaaaaagattgttctatttttataccataatgcaaaggaggcagagtgattttaagaacactgaagttaaaagcaattaacttggtaaaataaaatataggtaggtagataatcagatatatgtaaaaacaaacttcaaaaattattttaacatcataattttagataaattgaatcagtggcttattcttgaaggtatagtagcaaatgagatgactgttaagtaactatcaaacaactttttgtttgacatagttgaagtcagtaccatctgtgtgcaagagacaccgttcctatcacacagatagcatgggaaacacctgcctgcatgattcaattacctcacaccaggtccctcccacaacaagtagaaattcaagatgagatttgggtgggtgtgagaaatctactcatccatccaaacccaaagaatggacttagaggcatgaagaacagcgaaagtgagacttaataatggtcttgcaagattgggtgtctggtaggtaggtacatctggggcagtcacaacaagtaatttatcttctagtacgcaagtccctccccaagttcctcattggttgagtgctatggggttacaattttcctggatgtcacctaagtttcattatcccccttataaggttatatcccggtcctctttcttgcttgtttcaatttcccaataatgaaacttttttcccttttatgggctaacccctccttttcattgtttgcttactgtgaccttctaggtgcatgagcagtgcggtttgttaaatttgcaggctggcttccagtacttttgatttatcatgccttgaaaatggaccatttaaaatggtttctcataaattccctcctcttttctatttacttccttcggtcttctttttatttaagcccttttggtctttgaatcactggggacacagccaaaccatatcagcatttaaacactgtttccttattatgtaatctggataataaaactcgctctttctacattatgccacataaaatggaagtatagatgtgacactgtcattaaatctgtgaattatatgtcattatttttctaaaacacataaatcgtagtgaagttattccatctcagagacggcccatttaactataataaacttctaggtattcattatatagtgtattttttatcatcaaatcactgatcagatattttccttaatgatttattcttccatttgacaaatagattttggggcaagttctttgttaggtgttggcgtgatagcagtgaagaaaattcagcactcggggaccctgctgtctaattgggaagagcacatcgggggacacacagacatgggaacgtgcagggtttttagaactgagagacccaattgaggctctcagcaaagtcatttttcaggaagtggcatttaagctgagacctaaatgatgatttgtagtttgccaggaaagaaatccagagagggggaggggagaccacataagcaaagaccttgtgtcaggaaagaactttataccagagacggatggaggatgagagtggaagtcagaaaggcaggggctaggcccggtgcggtggctcacgcctgtaatcctagcactttgggaggccgaggcgggcagatcacaaggtcatgagatcgacaccatcctggctaacgtggtgaaaccccgtctctactaaaaatacaaaaaaattagccgggcgtagtggtgggcgcctgtagtcccagctactcgggagactgagggaggagaatggcgtgaacccgggaggcggagcttgcagtgagccgagatggcgccactgcactccagcttgggtgacagagcgagactccatctcacaaaaaaaaaaaaaaaaaaaaaaaaaggcaggggctaagtcactgaggcctgaggctgcacagggagctggatggtgtctttggaggaaacgaagacaaggaggttcaaagctgcttaaaggtcttgcaggaaagtgataaagtcagatttgcatcttttgaaaggtcatgttagcatcttttaaaaggtcatttataggagtctgccccagtactgcactgcatatgccacattgattaatggcaaacaccacttgggccctatttcctgcacatcgaacttgtaatacagcatgctctgccatgatggggacagtacgagatagttcattatgggaagacatgagaacctcctttatcttgaacatgagatggagatgtggagatgtcaggaaaattaacagaaagcaagcgacttctttactgagatctggagaatgaaaagaatcaggtagtaaggaaatgataggcgggtgtaaagggaatgtggcaggtgtctgaggtggtgtgggcagagcccatgaagctagaaaaatcattcttgttcagagcgaaaattgattcagtgtttctgaatagttgaatattctgctccatgaactgcttccgagtctggaaggggcatggaatatgagatgacattgaagatcaactcgggcataaagaatttgggatttaatccacaggcaaggaggagctcttacagtatctgaggggcacatttaagagcaagacagattatttttcagagaatctgctgtacattttggaaggatacccctgactgcagtgtgattccaacatgaagggacttgaggcaggtggcgtacataggatgcagaaacttatgccaaggatgatggcaccctaagcaagatgccagccatccagacagagaaaagtgggcacattcaaaatgtattaagaatgtggcatccacagggcttagagtgccactgagcgtcaacagtctggaatatgtgttttagcaactgataggatgttgctgtcaagatagggggcgctagagaataagacagctttggacgagaacaaaggaggtaatactggtttcaaatagactgagtattgcacgcctgtaatccgggcactttgggaggccgagggtgggggtagatcacctgacgtcaggagttcgagaccagcctggccaatatggtgaaaccccgtctctactaaaaatacaaaaattagccaagcacggaggcagctcacctgtaatcccagctactctgaggctgaggcaggagaatcgctagaacccaggagacagaagttgcaaaggttgcagtgagccaagattgtgtcactgcactccagcctgggtgattccgtctcaaacaaacaaacaaatagactgagtattaatggtccgtggctcatgcaagtggaggtgtctggttagcagtttgatatgaaagactgagctccagagagatctcataacttgggaatatgttttactccatacatattcaggtaagactaaagatcctgggattttggagtcatgggggaaagtgatattattcctgagcacttgctaggaactatccccaggttgcctcaggaccagcccctctcgctacagtaaccccataaagcagtgcctacactttacattttacgggttcgaaaccagctcagtgggacttagttaaccgcccacagtcaagtgtcagcatcaaaactggagtctcacccaaagccagctgaccccaaagctcacactcctgtaagatgtaattgctcaagagatcttagacctcacctgatccaatctcttttctttccccgttgagacggagtcttgctctgtcacccaggctggagtgcagtggcgtgatcttggctcactgcaacctccacctcccgggttcaagcgattctcctgccttggcctcccgagtagctggggctacaggtgtgtgccaccacacctggctaatttttttttttttttgtatttttagtacagacggggtttcaccgtgttagccaggatggtctcagtctcccgaccttgtgatctgtccgcctcggcctcccaaagcgttgggattactggtgtgagccaccgtgcccggcctcctcgttttctttaacagatgtttttggttaaaactcctgagttgatttgttttcattactcaaagcataatacagcaacgataattaagaacaaaggctccagagccttacaaagctccctgctcactgaacgtgggctctgggtgaaatcccttaacctcattgtgcctgagtttcctcatctggaaaattatgagttctcacttcagagagatgcactgagtgtgcatgcacaataagtgctgttttatttttattaatgtacatatttgtagaccacaaatgcatttttataaaagtttcaaacaatgtctaagtttagctagtaaatttatctaaacacacctgtgttgtctggctgcattctagcatcaatggaatattactttatgcattattatctgacttcctttcttctctcatgtcatttctgtcttggtgatctctccgtgtcacgccgtagctaggtttctctcctactttctcacagctgcaccctgctagatagcaaggattcagaatgatttttctatccctcactgataacattctagagagttgtcaggtttttagaaattattattacaaacagtgccgcagtaaacattctactacatattagggggatgttttgtccttatttgagaatttctgtaagaaaaatgcctatgttctaacaccggatgtaaaacatataaatagattacgctagagcaagaggttcatatactgagtgtttctaaaatattttttgatttaatagtttattactttcattgtgtaactgtacatgctccaagtacattctacaggaaaatctcaaacacttcaggaaagcagtaaacattaccataatgtgataaaattggtattttattaattttaaattatatttctaacacataagccatattacccttgacaaggtactctcgttaggagtcagacaaatttatgaatgtgtgcaatctctattctatttctgtctaggactatatttctttaaaaactagtagctcacattcttaggaaactaagatagagaaaagaatagaggttttcaagttggaagatcttaatcagtgtggtttttaaagtttcaccttattaagttgaatgaacaatgggagatcacagtatcaattattcaaaagtgattaatgcaggttaaatgccaacaggctggaagagcatgtaaatgcatcgctaacctcttagcaactataaagatttgtttgtttacatatttcaccatatggatatcattgaactcttcagccttataatggatattttgtgaataaaatattattttgcaagaaataaaaaatagtgtttgtcttttagcattgcacggttgaggctacatttactcaatagttcaaaacaggtaatttagtgctaggaatatcatctcccctgagcatagctgcaatatgctctatacacagggaactatctgttttaagatttggtataatggggcccggctcagtggctcacgcctgtgatcccagcactttgggaggctgaggtgggcggatcacctgaggtcaggagtttgagaccatcctggccaacattgtaacaccccatctctactaaaaatacaaaaaattagccgggcatagtggggcacgcctgtagtctcagctacttgggagaccaaagcaggtgaatcgcttgaacctgggaggcggaagttgcagtgagccgagaatgtgccactgcactccagcctgggcaacacagcgagactctgtctcaataaacaaacaaacaaacaaacaaacaaagaataaattaaaaagatttcatataatggggcagctgcttttaactggaatgcaataaatcctcacatactttcgaaagactgactttggtgagatagcatgctaggcatagagagacagggacctcactttcaggactgtcacaactcagtgcctgacacaggcatgtaggcaaacctcatgctgggaagttcagaaaagggaggaaagaacgtgtggcgaaggaggccaggaaacactccatcttacagctctgtaaatcagaggtctgccacagtctttctgggctaacgtctgtgcgtcagtcggactatcatagactcaacattctttaaagacctgaaattgcaaattattttatttcctggagcaaaaccaggtgcccatcacccatccatcacccaacacacatacacttcttttgcaaattgctacagttacaacaaagttgtggtcaatttgcagtaacaattaaagatgtccataggtgtgaagagctgaggtaaggaaagtcacattctccttatatgagcctgactcacaaaggacttactgtgaaggaaggtgagagagtcctggagaggctacatgagattgctgagccctttcagaacccatttctcaggcattgctggttgcatgaggttacagtttattggacctgccccattacctggtggagcgacctgtgcatctcttcgaatctcccagaaagagatttgggctcatggggcctgagggcctgagaggctgctccataagagctcagtcttcgcaactcacttcaggcgctactatggacactatggagcacttctttttttgttgctgttgagttttgctctgtcacccaggctgcagtgcagtggtgcaacctcagctcactgcaacctccacctcctgggttcaagcgattctcgtgcctcagcctcctgagtagctgggattacaggcatatgccaccacacccagctaattttcatttgtttttttttttatttgtttgtttttttgagacggagtcttgctctgtcgcccaggctggagtgcagtggcgtgatctcgggtctctgcaagctctgcctctccggttcacaccattctcctgcctcagcctcccgagtagctgggactacagatgcctgtcaccaagcccggctaattcttttttgtatttttagtagagacggggtttcaccatgttagccaggatggtctcaatctcctgacctcgtgatccacctgcctcggcctcccatagtgctgggattacaggcgtgagccatcgcgcccggccaattttcatacttttagcagagatggggtttcactgtgttggccaggctggtcttgaactcctgacctcaggtgatctgcccacctcggcctcccaaagtgctgcaattacaggcatgagccaccatgcccaggcactatggagcacttctaaggacttttgggctttggagaataccaacctagcagaaatggttccttttggaaaggacattggatgacatcaaatgctcagcataaagtatatgctttgagtacctgtcactcttctaggtgaccctcatgaaaattgtatgaggaagttattgtggagaagcgatgaggcggggtcatagagagaacagggactaagagggtgcaagaagttggggaagttgtagagctaggtgacagaggagcagagcagaagaaaaagcctcggtgttgggagaaaacatgaagaaaaaataagttttgtgcttggtcctatgatatgaactgcctgatgctggtggcatgagggaaggttgctttagctataaaggtacaacatccatcaatattccacagtactccacattgcctttctccaagcactctccagagaaacagacaccactcatcagtgggagaaaactgaaccattttgtagaagaatctccaattataaagagtaaatgaatggatcctttttatacctcagactcctgaccacattgcatctcgacaatgatgcaccttgtcatcattgtcatgtgacagtttttgaatctggtgtttttctttctgcaatagtaaggccaatcctgcagggacagaagtctgtgcaatcactgtgaaacacagctggaaataaggcaggaagaacttacagagctcaaacgtgcccatcagaatattttgaaacataagttacagtataggaattctcccctaaagtctccaaactggagtgagaacagctgaattacttcataatacaaaaacattcgcagaatctctatgaaattatgaaaattaaattctaaggtgcattttcataaatgaggtggttgctgtgtttattttctgttgctgcaaattttgccacagactcactggcttaaaatgatgtgcatttattatgtcatatgtctcccgatccgtgggagtctgcttggggtctcgtgaggttggattcaagatgttgcctggatacattctcatcttggaggctcggccagggaaagagctgcttccaagacccctcaggttatcagcagaatttgtttccttgtgattgtataactcagtacgcaccatcttcctagctgccagctgcggacccctctcagcttccagagattcctctcaaggcctccccacgcggcctggcatctcagcagcagagaaactctctcatcttcaactctctcaggcttctcacctctctgacttcttcaaagctctgattaagtcaggtgcacctctgattaagtcaatgcattcaaataatatccctatcttagggacaattgtgccatacaaatgacctaattacaggagtcaaacacattatattcatggttcccggggttaggcagtgtttgtatgccaggtggatgggatatcgccttgggagcgccatctttagaatcctgcctaccacaaatcccaattctataacacaaaaggcctgagggcttcagcaccatcacagcaggaggtataagtttcccagatacccaaaggtatccgctgtctgtctccacctaacatcccatgttcataccaggtggtgaaaaatccactcgtcatccataccattcagaagcatacagcctggattttgtcattctagttcttgtcactgtgtgtttgagcacatactagctagagaagctctttcatcatcagctctacacagtgcaatcctcaaaatgcccaccgttatccagaggttaccaatctctctcttttaattacacttaaactagcagaaatcttcttcatatcattaacccaaatggagaaaagaaagctagaaaattatacatctatttttccaccaaaagaaaagaaaaagaacattttcctcccacatttattgtgccttcaagtggttatagcaacctgttaagatcagccagtgtcgttaaactgcttcccagcgaatacagccagtgaagctgaaagagataataaagtttcttaggagaccgactactacactggcttgacacttgctccatacagaagaaaaaataaatcagtagttacacctccagcagctactgactagacatccttgcgttaagggtgggaaattcaatatacaaagaagcaaagtgttgacaataaaaagaaagtaaaaactgaaagaaaattgtaattggattgaatgtggctaaaatcaagatatgaaaaagcagaaaacaaagccaattcaaactctgaagaaagaataaatgagaaaataaatgaaaaaaattaattggctcagcaagtcatgactagaaaaaattaacattattaaattattctaccttcgggcatggaataaaatgaagatgtaagtattcatgttaatttcagtctatttctgaatggtaaattgctttctccttcttcctctttgtatgtttaggtctgggaaatttgtttggaattagcaacctgggatgaggtttattaagacagaatgactatgagcttgcctgcaaagtggccgctcctttcttcccttcttttccatcaggtcattcgcccactgagaggtggtatctatttctgtgcccccatgaatctgcatttgcagattccaagattaggacataagaagctttttagcttttgcctgggtctcgtggaatgcaggggaatctggggaaagccaagctctctacaaaaactctgactagcccaagactgtcatactgtgaggaacctcaagcttgtcacatggagaggctgtgtggagaccaagttacctgaccagctcctagctcttcaatccatagcattccaggtgccaggtatagaggtgcagaagctttctgacagcttcagccttgtctgccatctgaggtgccacaagtgagaactaatctggagtaatcaacatcaccatcccctgccatgaaatcaatgcagtgtgttcattcactaaattaggaggcagcttgttctatgcagtggtacagaacaggaacaatgatgcttagggctggggtatgggttgtgagggaagaaattccatgtcagcaaaacttcagagcatactacatcttctgtttgtttgtttgtttgtttgtttgtttttgagacagagtcttgctctgtcacccaggctggagtgcagtggcacaatcctgactcactgcaagctctgcctcccgggttcatgccattctcctgcctcctgagtagctgggactacaggtgccagccaccacgcccagctaattttttgtatttttagtagagacggggtttcaccatgttagccaggatggtctcgatctcctgacctcgtgatccgcccacctcagcctcccaaagtgctgggattacaggcatgagccactgtgcctggcgagcatatgaaatcttaaaggtcacgcagctgaatttctgagcttacgaaaaggaaaccaggtactcaaagaagctgtgacctgccaaaagtcacccagcaaattaatagtggaaccaaagtaaaaatcaaattttcagcatgtaatgtccttacaccacgtaaaaaaggtttgggttccttagtttgagaaatgtcaataccccttcataaatcaagggtataaactttgcagaaaaattaaacttcttaccacctggcatccaaactggagtgagaacagctttgccacatctacattcccactcctactcagaagacagactccaagaagcataaaacttctggagtcctggggtaacctgagcaaaacccgtgataggtttccaggaagcaagggcgtgagcaggggtggagactgaagccccatccctgcaagggtccactctgaacctcaaggcccataatcctcccccatatttctctgctctgccatttttgggtgctctgtcaagtcccaaacccctcagtaagtctgtcttttcttctactctaagcacctctattcttctagctcaccctttcactgtggtcctgccttccagctctttccttctgtgccctctgggaactcattacattttcaaaaaggactatctcaacatcatcacagaatgcccttgtatagcatagcgtttgagagtatggcttggaagcaacagtctggatttctaatgcagactccaccatttaccagtcacaaaccttaacaagtcacttaatgtctctgaacttcagtatcttccactgtaaaatgaaggtatccattgtgaagattaaataagatgatgcccataaaatgcacaggctaatgcctggcacacacaaaaaataataaaacaacaaaaaaagggttgactatacatcctcaactccactgaagcctagaccaccattttcaatgcccttgtagaactcattatttccatagtttgtctaccatagcatcaggaaacatttctggtaaatttccatcaattcctggtcactggtgttcataaaaagaagcaagtaggctaggcgccgtggctcaagcctgcaatcccagcactttgggaggccgaggcgggcggatcatgaggtcaggagattgagaccatcctggctaacacggtgaaaccccgtctctactaaaaatacaaaaaaaaaaattagccaggcttggtggcgggcgcctgtagtcccagctactcaggaggctgatgcaggagaatggcgtgaacctgggaggcggagcttgcagtgagccgagatcgggccactgcactccagcctgggcgatgcagcgagactcagtctcaaaaaaaaaaaaaaaaaaaaaagcaagcaagcaaacaaaatgacaatctcacttatccttttagacaaatatcagctgattacagcaacctctaccatttctagcaagtgtcatcttccaaatgggtcattttcttacatccatcaccatcttctcaattcctcaatcttcaatttccttgtagatgacacttaagtgctaggaacttgcaattccttcatgtgtaaatgatcttcactgttgctccttttcagcacccatgccatggacgtacttggaacttctcatgacctaggatggtaccatctttttttttttgagacggagtctcactctgtcacccaggctggagtgcagtggcgcaatctaggctcactgcaagctccgcctcccgggttctcgccattctcctgcctcagcctcctgagtagctgggactacagacgcccaccaccacgcccggctaattttttttttgtatttttagtagagacggggtttcaccgcgttatccaggatggtctcgatctcttgacctcgtgatcagcctgccttgacctcacaaagtgctggaattactggcgtgagccaccgtgcccagccaggatggtactatctttaaggatttttttttttttttagatggagtctagctctgttgccaggctggagtgcagtggtgtgatctcggctcactgcaacctccgcctactgggttcacgccattctcctgcctcagcctaccaagtagctgggaccacagacgcccgccaccacgcccggctaattttttgtatttttagtagagacggggtttcactgtgttagccaggatggtctcgatctcctgaccttgtgatccgcccacctcggcctcccaaagtgctgggattacaggcttgagccactgcacctggccgcatactttttaaaataataaattatccaatactatctaactatggagactatcattgggttcattcataagatatagtgaccttaaccccattcattcaaaccatatcagattctctttttttagtgcattgaaacattattctttgccaaccttctgtattgataaacatcaggatggcaccaaaaatctaaaatatgcaattctataaaatgtggcagttgtaaatgtgaatttggtgggaacttaatacctgaaccattatttcctcagttggcaaagtgaagttgtttcctcttctttatgagattgcagcagaaacatgcaatttaaaaagcaagagagaattagggatcactcaggctcaactcgattccaccataaccctcatttttcaaccaaagtaaaagaatctcatgcatgttgcgtgactagctgttggagatgttcttgttaggaccccttcatgagtagtaccatgtcttctggctctcggcctgctgctctgtccacatgacatagaagagtcacaacaaggtgacagacagtcacaagtgctgcaaaatcattgaacaaatgaacaactgtgggttccttttcagttactagcaaaacataggtgcaaaactaaaattgttatatttatatttataccattaataaatgttacaaggttataaacatcatacaatgtatgagggattcctgttatctttcttataaacccactgtatagatgctttcccgcacatgctgttctatcagagacccttttcctgtttctgcctgccttcttgatctcatccaaaaggtcagaagagtctggctctcacctgcaggttcaaggaagccccagtagcacactcatggctttctactctctcctattctccactgcaacttaaagatccttcacatcttacctcaagacaacaactccatggtcacggcaaagcattaagtataactactatatattttttacaaatatactttaaattatctcatatcaatgaaaagaaacacatatatggagtaaaaaaaaaaaaaagtcattcacttcacaccgctggctctctcacttggggatcagggaacactaatttcttgaagatccttccagaaataatcctgtacctttatatgcatgtatatgtataaatcttatttggaaatttcaactgagaacatattttggggttcccacgactacatcatggtcatgatttgctcagtgattcaccggaaggactcatgtaagtcaaaaagttatgcttacagctaagatatattactgcaaaggatactgtgcaggaactgtgagacacatattttgcatgcataagcaaagactagagaggtcaggcccaggtttccacgttccttctctcgcgagaattgtgcagacacgccctttctggctgcaaactgtggagatgtgtggcaggcatctccacctcagaaagtccgctcattagtgaccagcctgcccaacatggtgaaatcccgtctcttctaaacatacaaaaaattagccgggcgtgatgacgggcacctgtaatcccagctactagggaggctgaggcaggagaattgcttgaatccgggagactgagcttgcagtgagccgagattgcgccattgcactccagcctgggcgacaagagcgaaactctgtctcaaaaaaacaacaaaaaaagtccactcaaatctcagaatccagagttcttaaaggctgctgatcacacagctacccaaccagccaagttgcagatgccaaacaggcaccaggtacacatcattaattttcatgtttaaacaatgctgtcagcccagtacatcctgacccactgcctgggccatagagaatacaatcttaatcactgaccaagcgaacattcctgtcgttagttctcttcctgtggctccaagctttcccagagattaaaaagagctgagtaaaacaaacctactgtagtcattttttatgcacggagcacaatatgcacactattctgtattttgcctttttaaaaggcaatatatattaacgttatcagtaaatatgaccttattttttcatggctgcttgttattctggggcatggaggcactattatttgcttagtcagccacctattgctggagaactggacctgtactatttcactgttataaaaattgatacaattaacatctccatttagcgggggatatgagtatttctcataagaatcaccatttagaaaagaatgaatatggccggtcttggtggctcatgcctgtaatcctagcactttgggaggccaaagcaggcggatcacaaggtcaggagttcaagaccagcctggccaatatggtgaaactaaaaaaaaaaaaaaaaaacaacaaaaatagccgggcatggtggcaggcgcctgtagtcccagctactcaggaggctgaagcaagagaatcgcttgaaccagggaagtggaggttgcagtgagccaagattgcaccactgtactccagcctgggtgacaagcaagactccatctcaaaaaaaaaaaaaaaaaaagaagaaaagaaaagaatgaatatgaaagtggacttatagtaacccaccagcctccttgtggattgccttcttccactcagaaaagttgtcatttatttatttgtatgacattgccaattatccctcttgtgttatttttaaaattttcccaccagccgtctaaatgactgtcacctactccccacaccctaaggcagcaatttctgatttggaaccatgggaatttcactttcacaatttcatctgccaacatgcaataacatctgtctctatgctgatgtggttgtgcatctgggcctgggtttaaatctctgtaccaccttaactagcaaagtgacattatgcaactgacaatctcttgtgatttttctgtgaattaattgaatatttacgtgtaacacaccaagtgttctgcaaatgctagctttactggtttatttagtattctaatttaaattgataaaattctttttatgattgtcttctgctaagcagtaatatttaaggctgatgtgtgatttatatattattccaagacatataactacaagaaatatgcttttcctatccataattttaaaagcactgtgttaatcaacagaatattattaaatatttggacagtatcagtttgaaaagttaagtgaagttatatctcattgctgtgacccttcttttgtggtacgttcttcaaggtaaaaacaaaatatgtatcaatcaaatgaaacactgttttgttctgaatgttaaatttgctttgagtaattgcttattgtttttcttctaaaataccatattcccaggatgttctaggaacttctgtttggcaaaagtaaaatccttatcacatgaagaacctgcacggtaggaaagaaaattatcttacagtttaagttgtcagtgaatttgaatagtaatgcccaacttgaactcatgagaagtagttaaccttttcaattagagttctgatgagtttttaatataagcaataaatccctaattattattatagaaagcacaaattagggaaaaattacagtcctcaaagacatggctaaatctaaactcttaggtgcctggaaattatttactgatagaagtaattagagaagaaacctggtgctttgttccactacagcgatagctgctgggaagagggcacctcttggatgcatagacatcagggagcagtgtctagagctgggttctttttttctgagatggagtcttgctctgttgcccaggctggagtgcagtggtatgatctccgctcactgcaacctctgcctccagggttgaagcgattctcctgcctcagcctcctgactacatgggattacaggtgcctgccagcacactcagctagtttttgtatttttagtagagagggggtttcactgtgttggccaggctggtctggaactcctgactgcaggtgattcacctgtctctgcctcccaaagtgctgggattacaggtgtgagccaccgcacctggcctggagctgggttcttaaggcccatccaattgcagggataggcagtaggtcagggtggcacatgaacacagtttggaaaagtctacacaatttcagatggctgaaagttgaggtaaaaggccgaaattaaaccagtctattccacagaataaatgttcttgttgatatttgaagtgcacccaagaagtacagagttgcaaatgattcactaaatttacttcattctgctccaagtacctaagggtacaaggaattggaatcttctgccttcctttttagggggcagatgagaaataagagaaagggaagcctctgagaacagggaggtagaagggagagcaaagggtctgttgtaaggggtgtgggagagacagcagatttggaagcagggtacatccagccctctctggccttcttggatgagcctctctcctcccatctttgggactactatggggattacctcgtttttgtttttttgaagaaagcatggttacatttgtcttatatattttttaatttgtatgaatttatgggtaacaagtgcaattttgttacatgcatagtggtcaaggcagaacttttagggtatccatcacccaaatgctgtagattgtacccattagtaatttctcatcatccccccacaattctgagtccccactgcctatcattccactgtctacatccatgcagacactttttttagcactcacttatgagcgacatctttctatatctggcttatttcgcttaagataatgacctccagttccaaccatgttgctgcaaaatacatgatttcattctttttgtggctgaatagaattctatcaggtatatataccacatgttctttatccagtcatccactggtggacccttaggttgattccatatcttttctattgtgaatagtgctacaagaaacatgagtgcaggtacctctttgatatattgatttattttcctttgagtagatacccagtagtaaggttgtgggatcgaacagtcgttctagttttagttctttgggaaatctctattttcaataaaggttgtactaatttacattcccatcaacagcatacaaacattcctttttctccatatcctcaccaacatagcagatgagacattttatctttttaataatagccattttaatgaagatgatatcttattatggttttaatttacatttctctgatgattagtgttgagcattttttttatatgcccatgctggccatttgtgtgtcttcttttgaaaaatgtctatttatatcctttgaccacttttaaagaacattatttgttctttttcttttttttttttaattttttttttttagacagagtttccctctgtcgccaaggctggagtgcaatgtggagtgcagtggtgcaactttggctcactgcaacctccacctcccagattcaagggattcttgcctctcagcctcccgaatagctgggattacatgtgcccaccaccatgcccggctaatttttgtagttttagtagaaacgggctatcgctatgttggccaggcgggtctcaaactccttaagtggtccagtcgtcctggcctctgaaagtgctgggattataaacgtgagccaccatacctggccttgtttgcgctttttgttgttgttgagggagttgtttgagcttcttctatattatggatattagtcccctatgggataaatagttttcaaatattttctcctgtgcattgtctgtttacacacctggttatttcttttgctgtgcagaagctttttagtttaattgtcccatttgtctaattttggttttgttccctgtccttttaggtcttaagtcataaattctttgcctagaccaatgtccagaagaattttctcaaggtttttagtattttgatagttttgggtcttatatttaagtctttaatacatcttaagttgatttttgcatatggtgagagataaaggtctgtgtccagatttggttcctgccagtgggttggtggtctcgctgacttcaagaatgaagtcacagaccttcacggtgagtgttacagcttttaaaggtggcacggacccaaagagtgagcagcagcaagattcactgtgaaaagcgaaagaacacagcttccacacatggaaggtaacccaagcagattgccactgccagctgaggtggccagcttttattcccttatttgtccctgcccatgtttggtttttgtcctatcagagtgcccttttttcaatcctccctgtgattggctacttttagctactgctgattggtgcattttacagagcactgattggtgcattttacagagcgttgattggtgcattttataatcctcttgctagctacagagcactgattggtgcattttacgatcctcttttaagacagaaaagttctccaaatccccactcgacccaggaagtccagctggcttcacctctcaggttctgttttattttcctgcatatggctatctaatttcccagcaccgtttattgaaaaggatgtcctttcttcagtgtctcttcctgttagttttgtcaaagaccagttggctgtaactatgtcgtgttatttctgggttctgtattttgttttattgatctatgtgtctgtttttacagaagtattacactgttttggttaccatagccttgtaacataatttcatatcaggtaacgtgatgcctccagttttgttctttttgcttagaattgattttgctatttgggctcttttttctggttccataaggatttaacattgttttttctaattctgtgaaaaatgacattggtattttgatagggattgcatttcatctatagattgctttgggcattatggtcttttttttttttttttgagatggagtcttgctctgttgcccaggcgtgatctcagctcactgcaagctccgcctctcaggttcatgccattctcctgcctcagcctcccaagtagctgggactacaggtgcccgccaccacacctggctaatttttttttttttgtatttttagagacggggtttcactgtgttaggcaggatggtcttgatctcctgacctcatgatctgcctgcctcagcctcccaaagtgggtcattttaacaatattaatttttctgatccataagcatggaatatttttccattcgtttgtctcactgacagtttctttcatcagtgttttatagttttccttgtagagatgtttcacctccttgcttaaatgtattcctaggtagtttattttttgtagctcttgtaaataagatttccttctcagctagtttgttattggtgtatagaaatgctactgacttttgtatattacttttgtatcaattttactaaataaacttactaaattcatttatcaaatccaagagtgttttggtggagtctctaggtttttctagacaggtaatcctatcatcagcaaacggaaataatttgattttctcttttccaatttgaatgtcttttaattctttctcttacctgattgctgtggctaggacttctaatactatatcaaataggagtggtgaaagtgggaatacttgttttgttccagttcttgagaaaatgctttcaacctttcccccattcagtatgatgttggttgtgggtttgtcatataagccttttattatttgaggtatgttacttccatgtcaagttatttgagggttttttttttatcatgaagggatgctgaattttatcaaatgatttttctgcatctattgaggtttttaatccttcattctattttcgtgatgtatcacatttattaatttgcatatgttgaactatccttccattccttatgtacaacccacttgatcatggtgtattacctttttgatgtgctcttgaattccatttgctagtattttgttgaggatttttgtgtctatgtttatcagagatattggcatgtagttttctttttttgttttgttttgtctttgtctggttttagtatcagagtgatactggccttgttacatgaggaatgaagaagtccctcctcccagattatttggaacagtttcaggaagattggtattagttctttgtacattttatggaattcagctatgaatccatcaggtcctggactttttttttccatgggaaatttatttattactgattcaatcctgctactcattattggtccattctggttttcagtttcttccttcttcaatcttaggaggttgtatgtttccaggaatttagccatttcctggggatttttttggtttgtgagcatgtagttgttcataatagtcacagatgaaattttgtttttctgtggtatcacttgtaagtcttcttttcatttctgattttgtctcttctcttttcttggttgctagcagtttatcaattttgtttctcttttcaaagaaccaactttttgtttcattgctcctttgaatggtattcttacatagatgcaatgataatatgtcctataggctttagaagaatcttagtgcattgtcaaagaaacatttttagttgagcacatacattatgagcaaaggagtggcattagatcttcatagtagaaacagttatagtgtttctaatacatgtgtttcttagagagaatctaacaacattgaaagggcctactcacaaaggccactgtgcaaagataacaggaaactccccaaaagcttatcttcaagttagctgcatcaagtcctgtggtgcttgaaaatctctccattaatgctgaattgaagactacagggagatgaaaagactgtaggattaatatgcttcatcacgataatctataatattaagaaataatttaaaattgttgaacaaatatgtcatggtgtatgtcccaaaggttcattatgggctattgaattaataactttataaatctattcacatatcacctaagacataaaattattttgaaaagaaacagtggaatttgatatacaaacattttagaactcgaattgccttgtaaagatgtccacatatgattgggaaagaaggcagaccttcccagagggagtgagtaaagcatcatcagcaaataataagttaaacaaagtgaataaaagcttattgttaggtatgtaatgtttgtgacaatattgtaggaaatattgtacataaaatgctgtatggagtataaactcagatgtaacaggatcatatttgaaaatagtaaatatgtttaatattcttcttcttagtaaatcatgttccctagccatcattttaccttattgcaataccaatccaaaaagaggagaataagaggccatgtagttccacatcagcccagaaaaggcgtcccctctttctggtcatgacagattatgagaatgaaaaggggatgaaggcagaaagttcaggaggtgagacacgtatctaaactcctctatcagagctaaagtcccagaagtcaagtcttcttagctacactgaggaacaagtgaagaagagatgatgactttaatttagcttcctacttgagtttttgaagggagatcacttagcagggtacttgtggtagcctgttcaacaaatgtttccggttcttttccctttcaggtacacagcataattgtaattcctgtccacttgaggtagggtggaactatgtaactaattctgcccaatgacttgtgagtggaagtggaagcatttgattaccagagtgagaccatccagagctcttcttttccctctggcacagagtttttcacatgtctttcaagacaacacatatattagctgagaatatgggtacaaattaacagaggaaatgatcaggaagttaattgagtctgtagtcaagggcagaaatgctactcaatgccagcaatcaggtaggccttacaatcagagtttggagtgcctatagcatcagcagaaatgatgtggcactcatcagcaaagggcgatgtacttgtttctgggagtatggcctataccaactgaatggccagtgggacgtagcaaccacagactttggaagtggtgttaaagaaaacacctgtgattaagtatagattaactataccttagtgatgtcatctaaggacctaaggactgaaggacctgaccagtggagaccaacacagatactcatatgtcccaagaaactctctccacctacccaatgccatgaatttacatgagccctcatatgcccaaattccaccttggaaaacattagcgagaggacatgaaaatctggaagacaacacttactggaaaagatctcatctaaaataggctattcaacccgttagagattaggccactgacttacatttgggtttttccaaatctaggcaaatacttctgtattagttttgactaaaaatggaattacaagcaggtagtcatttcctataacatctccaatactagaggttgttgacgatactgaaaagaaaaatgattaattcattttcatgacattttctaggctctaaagcagggatcttaaaaatcagagcagccaaatgcttctactctgtaagattaatctatggcaacatcttaatgagtcttttgcttatctggtgcctatcttcacacatgttgacacctatacatattgggtaaattatgatatgataaagctaaaagtgctgatcataggtaatgataaatatcatttgcacaaacagcttaattcactcagaattgacatacctgactccttagccatatttaccattgatgctgttatgtttgactgcagatatcagattcatttgacattcaaaatgtcatttaatacaactcagaggaaagggtgaaataaaaataaagggtctattggctctcatatttctagtaactattagaagaagtagtaaacagaagttcatatctcatggctacaagcagaatgtttccctgtacagtcatacaactttatcaatgctgtattccaaatgcttttttattagatttgagtcactgcacttaagatctgggaacactgaccagctccatctggctggcctttgtatctgtgaacaaagtagagaaatacagaagggttatagttttttttgggggggaagctgagaaaaaagggtcactattatgaagcttgagcctaaactttttggatatattaacattaaatacaacatgtatcagtaaacatttagattttataaattatatattttaataatttttattatgtatttatttgaaaaaatcagttttataccatattctattttgagatattgcattctaataaatagtggtgagttcatatggctaaaagtgtcataaagaaatgcttaggggtgaactttcctattgtaagtattttccttgtattttgtaatctgattttaagctatggtgatcggttgtgcactaataatggtatttctcaaaggaagaaatagtataatataaaaagtatttcataaagtgctcaattaatttttttgttgttgttgttgttgttgtttgtttgtttgtttgttttttgagacggagtgtctctctgtcgcccaggctggagtgtagtggagcgatctcggctcactgcaagctctgcctccagggttcacgccattctcctgcctcagcctctggagtagctgggactacaggcacccgccagcacacccggctaattttttgtatttttggtagagacggggttttaccatgttaaccaggatagtctcgatcttctgacctcgtgatccgcccgcctcggcctcccttgtgttgtttgtttgtttgtttgtttgtgacggagtctcgctctgtcggccaggctggagtgcagtggcgcgatctcggctcactgcaagctccacctcccaggttcacgccattctcctgcctcagcctcccaagtagctgggactacaggcgctgccaccacgcccggctaattttttgtatttttagtagagacagggtttcaccgtgttagccaggatggtctccatctcctgacctcatgatccgcctgtctccgcctctcaaagtgctagaattacagaccgtgcctggactctccaaggtttattggtatttgtcttttccctctgtcttcacatggtctttcctttgtgtgtgtctgtgtcctaatctcttcaatatgacaccactcatattagcttcatatccatctctatgacctcattttaccttgattacttctttaaacgttctttcttcagatatcacattatgaggtactgggggtcaggacttcaacctgtgaattttagagatacacagttcggcccacaacataaatgaacctcgaaaacattatgctaagtgaaataaatgagacataaaaggagagatattgtatgattacacttacatgagatacatgaatagtcaaattcagagacaaaaagtagaagaatggttaccaagtcctggggaaagggttggaggaatgcggagttattgtttaatgtgcagttttgggatgacacgaaagttctgaaggtggatagttatgataattgcacaataatgtgaatacacttaatgtcactgaattgaatatttaaaaatcgtcaaaaagataaattttatgttatgcatattttaccacaataagaaagaaaactctagaaataaaaatatagtaacagaaatgaagaatgcctagcaatgcattggagagggaataaatggtatcaaaattaaatcttttatttttcttattcttaatatgtgtaaagcataacatttaaaaataatagtattacaatgtattgcatgattatcaaatatgaataagtgcgattaatgatagcagtattacaagggacatgagagagaagttgagaatattctgtatgaggtacctatactgtacacaaagtaatataatgacatctgaaagtggactgagagtacagaatcgtatattgtaaactgtagagcaaccattaaaaaccttttaaagagaagtataattactattctaagaaaggaaataaaatggaatcatataaaatgatcaattaaaaagacagaaaaagagtaggaaataacaaacagcaaattcaatgagcagaaaacaatgacaaacatagtagatatcactccacctatatcaataatcacttcaattatgaatggtttaaaaatgctattgtaactgtactccatttgcttaagaaggtagatgaaaagctatatacattaaggagagacatggaagatacaaacactaaaataaaacttctaaaggtaaaaatacaatatctgatataaaaattcattggattagattaacagcagattaaacattgcaaaggaaaagattcatgaataaaaatcatagcaactgaaactatacaacatgtcacacacagatttaaaaaaagactgaaaatgatgaagagggaatctgtaagctagataaactgcaagcagcttaatatatgtaagattggagttcccaaaaagtagtaaagaggagaataataaaaatgagggccaggtgcagtggctcacacctgtaatcccagcactttgggaggctgaggtgggcggatcatttgaggtcaggagttcaagaccagcctggccaacatggtgaaaccctgtctctaataaaaatacagaaattagctgggcgtagtagtgggggcctgtaataccagctacttgggaggctgaggcataagaattgcttgaacctgtgaggtggagattatagtgagctgagattgtgctaattcaactctagcctgggcaatacagtgagactcagtctcaaaaaacaaacaaaaaaaaacaacaacgaatatttgagtacacaatggctgaatatttacaaatttcatggtaactacaaattcacaattccaaaaatctcaataaactcaaacatgaaaaaattacaaggcacattaaagtcagattgtttaagactactgatggacagcgttaaatgcatccagatgtggagcacatgagatacaaactaacaaagaatgagaaaagaatgaaagcatattcctcattgaaagaaatgcaatcaagaaaacaagtatagcttttctaaaatacggaaataaaataaaagtactgaaatagttctatagtatttgtactcagggaaatcagattttcacaaatgaaggcaaaataaagagcttttcagacatgcaaaagctaaaagaaatcagtagcagaaccatatcacaaagaaatgctaatggaaattcttcaggcggaaggaaatgacacccagtgaaatctacctctattcaaaggaatgaaaagcatcagaaattatagctacatgagtaaatatttgtttcttattatgtaaatttcctttttattattactattatttttaaattatagtttcagttctggggtacatgtgcacaacatgcaggtttcttaacatatgtatacatgtgccatgttggtgtgctgcacccattaacttgtcatttacattaggtatatctcctaatgctctccctcccctctccccccaccccacaacaggccccagtgtgtgatgggggcctgtgtccaagtgttctcattgttcaactcccacctatgagtgagaacatgcggtgcttggttttctgtccttgcgatagtttgctcagaatgatggtttccagcttcatccatgtccctacaaaggacatgaactgatccttttttatggctgcatagaattccatggtgtgtatgtgccacattttcttaatccagtctatcatttttggacatttcggttggttccaagtctttgctattgtgaatagtgccacaataaacatacgtgtgcatgtgtcttcatagcagcatgatttataatcctttgggtatatacctagtaatgggatggctgggtcaaatggtatttccagttctagatccttgaggaatcgccacactgtcttccacaatggttgaactagtttacagtcccaccaacagtgtaaaagtgttcctatttctccacatcctctccagcacctgttgtgtcctgactttttaatgattgccattctaactggtgtgagatggtgtctcattgtggttttgatttgcatttctctgatggccagtgatggtgagcattttttcatgtgtctgttggctgcataaaagtcttatttgagaagtgtctgttcatatcctttgcccactttttgatgagattgtttgattctttcttgtaaatttaagttctttgtagattctggatattagccctttgtcagatgagtagattgtaaaaattttctcccattctgtaggtttcctgttcactctgatggtagtttcttttgctgtgcagaagctctttagtttaattagatcccatttgtcaattttggcttttgttgccattgcttttggtattttagtcatgaagtccttgcccatgtctatggcctgaatggtattgcctaggttttcctctagggtttttatggttttaggcctaacatttaagtctttaatccatcttgaattaatttttgtataaggtgtaaggaagggatctactttcagctttctacatatggctagccagttttcccagtaccatttattaaatagggaatcctttccccatttcttgtttttgtcagatttgtcaaagatcagattgctgcagatgtgtggtattatttctgagggctctgctctgttccattggtctccatctctgttttggtaccagtaccatgctgttttggttactgttgccttgtagtatagtttgaagtcaggtggtgtgatgcctccagctttgttctttgggcttaggattgtcttggcaatgcaggctcttttttggttccatatgaactttaaagtagttttttccaattctgtgaagaaagtcattggtagctcgatggggaaggcattgaatctataaattaccttgggcactatggccattttcacgatattgattcttcctacccatgagcatggaatgttcttccatttgtttgtgtcctcttttattttgttgaacagtggtttgtagttctccttgaagaggtccttcacatcccttgtaagttggattcctaggtattctattctctttgaagcaattgtgaatgggagttcactcatgatttggctctctgtttgtctgttattggtgtataggaatgcttgtgatttttggacattgattttgtatcctgagactttgctgaagttgcttatcagcttaaggagatttggggctgagatgatggggtattctaaatatacaatcatgtcatctgcagacagggaaaattggacttcctcttttcctaattgaataccctttatttctttctcctgcctgattgccctggccagaacttccaacactatgttgaataggagtggtgagagagggcatccctgtcttgtgccagtttttgcccattcagtatgatattggctgtctgtttgtcataaatagctcttattattttgagatacatcccatcaatcctagtttattgagagtttttagcatgaagggctgttgaattttgtcgaaggccttttctgcatctattgagataatcatgtggtttttgtctttggttctgtttatatgatgaattaaatttattgatttgtatatgttgaaccagccttgcatcccagggttgaagcccacttgatcatggtggataagctttttgatgtgctgctggatttggtttgccagtattttattgaggatttttgcaacgatgttcatcagggatattggtctaaaattctctttttttgttacgtctctgcgaggctttggtgtcaggatgatgctggcctcataaaatgagttagggaggattccctctttttctattgattagaatagtttctgaaggaatggtaccagctcctctttgtacctctggtagaatttggctgtgaatccatctggtcctggactttttttggttggtaggctattaattattgcctcaattttagagcctgttattggtctattcagggatccaacttcttcctggttcagtcttgggagggtgtatgtgtccaggaatttatccatttcttctagattttctagtttatttgcatagaggtgtttatagtattctctgatggtagtttgtatttctgtgggatcagtggtgatatcccctttatcattttttattgcatctattggattcttctctcttttcttctttattagtcttgctagcagtctattttattaatcttttcaaaaaaccagctcttggattctttgattttttgaagggttttttgtgtgtctatttccttcagttctgctctgatcttagttatttcttgccttctgctagcttttgaatgtgtttgttgttgcttttctagttttttttaattgtggtgttagggtatcaattttagatctttactgctttctcttgtgggcacttaatgctataaatttccctctccacactgctttaaatgtgtcccagagattctggtatgttgtatctttgttctcactggtttcaaggaacatctttatttctgccttcattttgttatgtacccagtagtcattcaggagcaggttgttcagtttccatgtagttgagcagttttgactgagtttcttaatcctgagttctagtttgattgcactatggtctgaaagacagtttgttataacttctgttcttttacatttgctgaggagtgcttcacttccaagtatgtggtcaattttgtaataagtgtgatgtggtgctgagaagaatgtatattctattgatttggggtggagagttctgtagatgtctattatgtctgcttggtgcagagctgagttcaattcctggatatctttattaactttcagtctcgttgacagaaagtttctgtcaattcctggatatccttgttaactttctgtctcgttgacagtgggttgttaaagtgtcccattattattgtgtgggagtctaagtctctttctaggtctctaaggacttgctttatgaatctgggtgctcctgtattgggtgcatatatatttaggttaattagctcttcttgttgaattgatccctttacattatgtaatggccttctctgtctcttttgatctttgttgatttaaaatctgttttttcagcaactaggattgcaacccctgcttttttttgttttccatttgcttggtagatcttcctccatccctttattttgagcctatgtgtatctctgcacatgagatgggtctcctgaatacagcacactaatgggtcttgactctttatccaatttgcccctctgtgtcttttaattggagcatttagcccatttacatttaaggttaatattgttatgtgtgaatttgatcatgtcattatgatgttagctggttattttgctcattagttgatgcagtttcttcctagcctcgatggtctttacaatttggcatgtttttgcagtggctgatactggttgttcctttccatgtttagtgcttccttcaggagctcttgtaaggcaaacctggtggtgtcaaaatctctcagcatttgtttgtctgtaaaggattttatttctccttcagttatgaagcttagtttggctggacatgaaattctgggttgaaaattcttttctttaagaatgttgaatattggcccccattctcttctgccttgtagagtttctgctgagagatctgctgttagtctgatgggcttccctttttgcataacccgacctttctctctggctgcccttcacattttttccttcatttcaactttggtgaatctgacaattacgtgtcttggagttgctcttctcgaggagtatctttgtggcattctctgtatttcctgaatttgcatattggcctgccttgctaggttggggaagttctcctggataatatcctgcagagtgttttccaacttggttccattctccccgtcactttcaggtacaccaatcagatgtagatttggtcttttcacatagtcccatattatttggaggctttgttcatttgtttttacttttttttctaaacttctcttctcacttcatttcattcatttgatcttcaatcactgataccctttctttcacttgattgagtcagctactgaagcttgtgcatgcatcacatagttctcatgtcatggtgttcagctccatctggtcattgaaggtcttctctatgctgtttattctagttagccattcatctcatcttttttcaaggtttttagcttctttgagatgggtttgaatatcctcctttagcttggagaagtttgttattactgatcgattgcagaatggcaaatgttgctgcctgatccttcctctggaagcttcatctcagaggggtactaggctgtatgaggtgtcagtcggcccctactgggaggtgtctcccagttaggctactcgggggtcagggacccacttgaggaggcagtctgtccattctcagatctccagctccatactgggagaaccactactctcttgaaagctgtcagacggggacatttaagtctgcagaagtttctgctgccttttgttcagctatgctctgcccctagaggtgcagtctacagaggcaggcaggcctccttgatctgcagtgggctccacccagttcgagcttcctggccactttgtttacgtactcaagcctcagcaatggcagacacccctcccccagccttgctgccaccttgcagtttgatctcagactgctgtgctagcagcgagcaaggctccatgggcgtaggaccctccaagccaggcacaggatataatctcctgctgtgccatttgctaaggccattggaaaagcacagtattagggttggagtgtcctgattttccaggtactgtcagggctacccttggctaggaaagggaattccccagccccttcttcttcccaggtgaggcaatgccccgccctgctttggctcatgctccatgggctgcacccactgtccaacaagccccattgagatgaacctggtacctcagatggaaatgcagaaatcactcatcttctgtgtcactcacgctgggagctgtagactggagctcttcctatttggccatcttggaacctcccctcatgtaaatttcttttaaagataattgattaaacagaatgataacaatgtgttgttattgcaacatatgtatatacaaataaagtatatgacaacaaagcataaagactgagaggggagaaatgcaagtatactgttgtaaggtttgaatagtatatgtgaaatggtataattcacttgaagctagattgtgataagtttaagatatatactactactccacagcaaacacaaaattagcaaaataaagaattataattttaagccaaaaaataccagagacaagtctcaatcaattcagaagtttatttagccaaggttaaggacatacccgtgacatagccttaggaggtcctgagaacatttgcccaaggtggtctggctacagcttgaatttccatgttttagggaggtataagacatgaatcagtacatgtaagacatacactggttaggtctggaaaggtggggtgtattagggttctctagagggacaggactaataggataaatgtatatgtgaaagggagtttattaaggagtatacactgtcacaaggtgaagtcccaaaataggccatctgcaagctgaggagcaaggaagccagtctgaattcccaaatctcaaaaatagggaagccgacagtgcagccttcagtctgtggctgaaggcccaagagcccctgccaaaccactggtgtaagtccaaaagtccaaaagccaaagaacttggagtccaatgttcaaagccaggaagcatacagcatgggagaaaatgaaggccagaacactcagccagtctagtccttccacattctcctgcctgctttattttagctgtgctggcagctgattagatggtgcccacccagattgagggtgggtctgcctcttctagtccactgattcaaatgtcagtcttctttggcaacaccctcacacatacacccaggaacaacactttgcacccttcattccaatcaagttgacactcaatattaaccatcacatggagtaatgtgaagggggaggaaggggcagtgggggggttgtggactgcaagtcataagtggattaaaagatttcctgattggcaatgggttgaaagcttttatctaaagacctggaattaatagaagggttaaaataaggggctgtggagaccaaggtttttattatgcagataaagcctccaggtagcaggcttcagaaagaatagattgtaaatgttttttatcagacttaaaaaggtaccaaactcagttaattctctcccggatcaggaagaagacctggaaataaaaggagattttctatagaaggtagattttcccacaagagacagctttgcagggccatttcaaaatatgtttaagaaatatagccaggcacgttggctcatgcctataatcctagcactttgggaggctgaagcaggcagatcacttgaggtcaggagtttgagaccaacctggccaacatggcaaaaccacgtctctacaaaaaatacaaaaaaataagccaggaatggtggcaggcacctgtaatcccagctattcaagaggctgaggcaggagaatcacttgaacctgggagacggaggttgtggtgactgagccaagatcatgccactgcactccagcctgggcaacagagggagactccatctcaaaaaaaaaaaaaaaagaagaagagggagagaaaagaaatatcttttgaggtaaaatatttttatttcttttagggcttgctgtctgtcatgttgatatcttaatggctaccaagagtctgtttcatcagtcgtaaggtctctgttttaatgttaaatgctggtcagctgtgcctgaattccaaaggaaggtgagtatagtgtggcgtgtctgacctctactacccatcatggcctgaactgattttccaggttaacttaggaatgcccttgtttgagaggaggggtccattcaattggttgatgggcttagaattttacttttgatttacatagttaatgaaccagaaaggaagatgaaatgtaataaaaatgtttgatccaaatggaaaaaaagaagaaaaaagaacaaaaatcaaaattatcgactcaaacctaactatataaataatcatattaaatgtaaatggtttaaacacctcaattaaaagtcaggaattgtcatataatttttttaggaagacccaattctatgctgcttacaagaaatacactttatatataaagaaacaaagaggttaaaaaatacataccatgttaacagaaatcaacagaaagctgataaatctagccagactaatcaggcattagaagaaaaaaatgccagtagcaggaatgagaaaggtgacatgattttaggttttacagatgttaaaagaatcataataaaatattatatataacttcatgtcaatgatttccacaattgtcataaaatagatgaactccttgaaatacacaaactaccatatctcactcaagaagaaatacataatctgaatagccctacatctgttagagaaatacaatttgtagttacaaaaccttcacataaagaaaatgccaggcccaagtggtttcactagtgaattatatcaaatatttaagaagtaatactaattttacatgaactcttcatagaaaatttttgagaaggtaattatttcctacctcattctatgaaattagcattaccctgatataaatgtcaaagacattacaagaaaagtaaactagagacaatatctctcatgacattagttgaaaaaatgcaattttagcaattaaattacagcattatgtaaacagaataacacacaaggaccaagggggcttatcctaagaatgtgaaattgtttgaacatttaaaaatcaaacagtgtactaagaagaaggaagacaaaaacagaaatgaaaaagacattgcaactgatgtcacagaaatccaaagatcataagaaactgctgtgagaaaaaatacaccaataaactcgataacctagaataaatggataaattcctagaaacatacaacctaccaagagtgcatcatgaaagaaataggaaatttaaacaggcaaacagtaaataaggagatcgaatcagtaataaaaaaaactcccaacaaagcaaagcctccgacctgatgactctgctgctgaagtctaccaaatatttaaagaagaattaataccaatcattttaaaactcttcccaaaaaatcaaaaaggagggaatatttccaaactcatttcacgaggccagcattatgtgaatttaaagacagacaaacacactacaaaaagaaaactacaggtctatgtccctgattaatatagatgcaaggatcctcaacaaaataattgcaaaccaaatttaacagcaaattaataggatcatacaccaagtgggatttatccctgagttgcagggatggttcaacatgtgaaaatcaattaatgtgatacagttaatagaataaaagataaaaatcacaaaatcatctcaatagatttaaaaataataatttgataaaattcgacactttttcatgttagaaactctcaacaaactaggaagagatggaagttacctcaacatattgaggccagatatgaaaatcccacagctaacaccacactcagagtaaaaaactaaaagcttttcctctaatatcaggaaaaagacagggatgttcacttttaccacttctattcaacatagtaatgaaagtcctgcccagaatgattattcaagatcaatacaaaaaatacatcaagttcagaaggaagaagtgaaattgtacctgtttaaacatgatctaatatacagaaaactctaaagactccacaaaaaactgttagaattaataagtcaattcagcaaagtagtatgataaaaaacaatatgtaaaaatcaattgtatttctatacaccaaaaataaactctctgaaagaaaattaggaaaccaatcccatttacaacattatcaaaaataatcaaatacttaggaataaacttagccaaggaggtaaaagacacactgcaaactgcaaaacattaatttaagaaatttaaaaggacacaagtaaatggaaagacatactgtgttcatagattggaagtcttaatatctacactactcaaagcaatctacaaattcaattcaatctccataaaaatcctaatagcatttttacagacagagaaaaaacaattctaagattcatatataattggaaagtaccctgaatagccaaaacaatcttgagaagaaagagcaaggctagaggcatcacttcctaatttcaaaatatattgcaaagctatagtaattaaaatagtatgttaacagcataaagatagacatttaagaccaatgggttagaatagggagccaagaaatagatctgtgtatatacagtcaattgatctttgacatgggtgccaagaatgcacaatcaggaaaggacagtctcttcaacaaatgctgctgggaaaactggatatctccatgcaagagtagaactggatccttgtcttataccataaacaaaaattaaatcaaaatggattaaaaacttaaatgcaaggtgagactgtaaagcttctataacaaaacactgggaaaaagattaatttccaaaatacgttaggaactcaaacaactcagtagataaaactaacaatctgattttttaaatgagcaaaggacttgaatagacatttttccaaagaagagaaatacccacaggtatatgaaaagatgctcagtgttactaatcatcagaaaaatgtaaatcaaaaccacaatgaaatatttcctcacacctgtcaggatgattattattaaaaaaaaaaaaagacaagtgttggaagggatgtggagaaacggaacctttgtacattgtttgtgggaatacacgatggtgcatttactatgggaaaaaagtatgaacggtcttcaaaaagttaaaaacagagccattatattgctccaataatcccacttctgagtatttatccaaaagaattgaaatcaggatcttgaagtaatattaccattcctatgttcattgcaacactattcgtaatagctcagatgtagaaacaacattaatgtccattaacagataaattcataaagcaaatgtggtatagacatacaatggaaataatattcagcattaaaaaagaaattctgcaatatgcacaacatgaataaaccttgaggatattattccaagtgaaataagccaatcacagaaagacaaatcccgtataatttgcttatcttagatagtgaaaatattaacagtacaattcatagaatcaaagagtggaatggtggttgccaggatgggagtgaaagggaagtgaggagttgcttatcaatgggtataaaatttcattaatgcaagatgaattagctttagagatctgctgtataatactgtgcctatagttaacaatattttattgtatactgaaaaatctcataagagagtagatctcatgttatattcttaccacaataaaataaaaattttaaaaatcaagcactgtagttcaccaaattgagaaattaaaaaagaaaagatcttatctcagtataatcagaagaaaataactctcagcaaactggcactagcaggaaacttcttcaacctgattaaggtaatttacaaaaaacctacaggtaatgtcacgcttaatgagttttctcacattttttcaacatttccagaaagatggttgactttgctgggttttctttccttttcttaacctataagaacaatctctgtaacctgcatcctttgcccacgaatgaactctgacttcctgaaactctaagtgagcaacttggttgttacttctggaggtatcagccttctgctaattgcatttaagatgccattgtagaaagttttggccacaggacctggctggaaaacactggccccactggactgtactctgtactcaaactttccttaagtataaagatttgatagagaatggcttttacataggaagatcctggggatggttaagcacatgagaaatgattattggggttctctgagaaagaaaattgtcagaagaggcaattgaatcaccgagatctacgaactaatgtagaataagtcactgcaagcatcagcttagtttctctccaaatgagaaagcagtcgtcaaactccttcacatatccttgaaacatacgaacaatctgggcatctgttgtctacacaggggttgcttctcttgaattctctaaacataatttggtacaatagagtattagtcttttgcatttgtgtgtgtgtgtgtgtgtgtgctgtgtgtatacacacacagacatacacacatatgccatacaatattttttgaagttttattaagtttaataattgaatgactaatactgcagctatgtctagcatattgtgttagaaagcatgcttagcctctctgtaagagagagccccagagaactgggaatgtttatctatgtagaaccatatatctagtagaaccatagaacatttatctatgtaggctgaatgtgcgatttatcatattctcaacaataatcctatgcttggtgaaatgtataagggacctttgcgtacctttttttctttttgcaacttcatgtgaatctacaattatttcaaaataaaaaaatttaaaaagtacatgtgtcaaaagaaatctcttgataaacataaaacaataaaaaaggaacctttgtcagaaacacatggataggctctctgtgattgtctctcatggctgttgcttaacttgaataaaaattcacatcatgtcaaatattacaagcaacattatctgtgacatagtctattgaagcagtcacattggcattggggagatacacaaacaaagcaaaccatagccatctggtattctcagcttgtttacaaaatcacttaacaaggctaagttgaagatgtggaaatagaggttcatctgggagtgaatggtctcacctgtccccgacttacttttctctctctccatttccctcagggctcaatgaagagggagtcatgaagaatttggatgagcaagtgcccccgtcctatgtatttatgtctccccactgatgtacagtgctccatctgtcataaatatctatcgactcaattctgagtcatttactggacttctattttttttcctttgggctatttcatctatcaggagatttgccccatgctgtcttgaaggctaacattatgaattttgattggtggtacggcagttccttacatcttattattattatttttattctacagatttgttttcaattcttcggcctttgactttttttgtacgaaggtaagaattattaatagttgtttaaatactcaaaaaacacagtgaaaatttttaggggaaatgcactgaatatatctatcaatttgaaaatggaggctgggtgcagtggctcacgcctgtaatcccagcactttgggaggcaaaggcaggcagatcacgaggtcaggagattcagaccatcctggctaatatggtgaaaccccgtctctactaaaaataaaaaaaattagccgggcgcggtggcgggcgcttgtagtcccagctactggggaggctgaggcaggagaatggcgtgaacccgggaggcggagcttgcagtgagccgagatcgtgccacagcactccagcctgggcgacagagtgagactccgtcttaaaaaaaaagaaaagaaaatggaaaagcttaaaatcatgagttatatagtattatcttacatattactatatacataattcagtgaattatagtattcaagaatatagaatgaattttcatttagttttataaatttccatgtttcttgatcttattgagcattcaaggcaatcaataaaatatactcctgatactagaaattccttatattttttgggtattttttgtggcatctgtacattgcaaatactttctaccagtctgaagattggttgtcactttgttaggttttctttaagatgttttttctttctggccgggcgcggtggctcacgcctgtaatcccagcattttggaaggccaaggcgggcggatcactaggtcaggagatcgagaccatcctggctaacacggtgaaaccccctctctactaaaaatacaaaaaattagccgggcgtggtggcaggtacctgtagtaccagctactcaagaggctgaggcaggagaatggcgtgaacccggggtctgagcttgcagtgaacctagattgcgccactgcagtccagcctgggtgacagagcgagactctattcaaaaaaaaaaaaaagagatttttttcttttcaatgtggaagagttaaattatcttttcctattgtggttttgtttcagacagtattcataagaaaattctcttattctttttactaaatgactcacatattttgtttcaaatttaagtttttaatcccactgggatgaatttagtgtaaggcgtaagtacggatccacaatgtttccatatggatatctgaatggtttaactgcttttattttattttatttatttatttatttatttattttgagatggagtctcgctctgtcacccaggctggagtgcaatggtgtgatcttggctcactgcaacctccgcctcccgggttcaagcgattctcctgcctctgcctcccaagtagctgggattacaggcgcccaccaccacgccagtctacttttttgtatttttagtagagagggggtttcaccatgttggtcaggctggtcttgaattcctgacctcaagtgatccgcccgagtgatctgcccgcctccgcctctcaaagtgctgggattacaggcgtgagccacagcgcccggccttgactgcttttaaaatagtcatctttctaaattgccctgctgtttccactttctcgtaggtatctgtttccattttgtttcttcagtttcattggcttgtctctattttttccaatacaaagctatcttaattaatttattttcatcataaattgtaaggtccagtagataatttctcttatgttattactgcatgagagtgtctttggttttctttggtgtgaggtttattttttcatattaattttgcgtcagcttatgaaggacattaggaaatctggttgaggttttggctggaattaacattgacaatttgggtggaattgatattttttatgattttgacttttcctattgatatttgcagtataaatctccatttatttgcttttattttttttctcttatgaataagttcacctttaaaatggtgaaaccatagtattcatctctcagggtaggttaaatttcttacaatagtgaggggactataaaatactttttatctttggtgaaatttacccctaagttcatagcatttgagtttgctattgaaaaatttgttatttatatttttaaattaacaattacacatttttttaaaaccagttaatcaccaagtatgctaatcctaaattacattttctctcctcactgatgtgtgtgtcccctctgtaagataccatgtggatataaatgctaagtatgattctgggcctctggtcttttcctgtgagctactttgtctctcactgtgcctataccactgtcttgatgagtctggctttctaaaaccttgattgttagtaaggcacgtgctccaaatgtatttgtttcttttacagatatttttgagttttcttacctctctttttttcaaatatatatgaaaatctggctatcgatgtcctcactcaacctagtggatattttaagtggaaaaatattgtatatagagagcatattgaactgtgagatgcttcatgtatggaactatcttatgcatgaacatagacctgattaagttatgtgcattgacaggttggaaagatgcatttaagatttaagaacaatcaatgacttcctctgtttccactagagtccccacaaaattgaaacacattaggggaaaaacgtagatgaagtccaaaatatttttaaaaatagctcacagataatgactcataggacaaaacattcagggttggagctcagccagctttaagttctcagagcttaaagggtcagggtcactagctcaaacctgaggcccctaatcagcctggcacctgtcctaaggttggaatgggctgatactttgcactggacactcttgttccctgagagatgcccactttgctctacttgcctcatttgttctaataagatcctatactggtgatgtcagcaggtgtctgatacaaggaaatatgttgtatggagtgggagaggtgaagagtagtgaggtagtgatttcatggtgtgggatacattaggaccaacccacttagaaaaaaatggccttagcaacaattttttaccactaatgcccttggcaaaaacatccttaagaacaattgcccttggcaccaacacttttaaaaatatgcctatcacaacaatgactcttattaataatggcccttagcaacaaatcccatagcaacaatacccttagcatagacaccatcaggaataatgctttaagacaacattgttaatattaacccttttagccaaaagactcttggcaacataatctaagcaacagtaacattagaaaaatgccctcagctataacactatttgccacagttgttcttagcaacacctttgactgacatcaacactcctagaagcaatatcttacattagcaatcatagaccttaacaaccaccccaaacaacaatgaccttagcaacaaatagcttgacatgaatacctttaccaaaatgtcctttaaaaaaatggcctttagcatcaagacccttaacaaaaatggcccttaggaaaaatgaccttagagacaacactcataacataacaacaatggtccctaacaacaatgtccttagcagcaacatcattagcaatggtgcaccttactgacaaatctctaagcaacaacaaccttagcataattgcctgtagaaatagtgggaattatgccaattgcaacaatgccattggcaacaatgtctttaaaatcaatgtccatagcaacaatgcccttaggaacaatggtatgtccatttacctctataaattgccatggtactttggaaatggtcaaaccatggcctgttagtgtatcttagcaaaaacacccttagaaataataccttcaaaaaccatggcccttagcaataacaaaattagaaataaagcaattagcaacaatgcccttacaaaaatgtcctttatagtggcattaacaacagcactcttaccaatggcaccttagtaaaaatgcttttagtatcaactccttagcaataatgacatcagcaacagtgttgttggcaacagcacactttacagcaatgtcctagctacaaaatacataatatcaatgaacttagcaagaatggctcttggagacaatgctccgaatggtaatactcatagaatcaacactcttaacatcagtaccattagcaagaaaggggtaaacaaccgaccttagaaatgacattcttaataatgtccttagtaaaaaaatcatgagcatcacccctataaccagtgcccttagcaacagtgctcttatccaaacttgccttaccaagagtttaccattgtttaccttataaacaatggcccttagcaaccacactctttgcaacaatgtcctaacaatattactattagcaaaaatcccctaagaccagcattcttgacaacagccctcttggcccttagaagcaatgactttagcaaccaacggtgagccataaaaataaagccttggtaataatgctcttagcattgaccttagtaaaatggtcttagcaacagtctttagcaagagtgactctagaaatgtccccttcccaacaatgccctttgaagaaaatacctgtaacaacaatgcctttagtcacaatgccttcagcaaaaatgtcccttgccaacattaacaccctaggaacaatgatctgagaaacagtgtccttaacaataatatacaaaaacattctaagcaatagtaccctaagcaacaatatacttagcaataataccctcagtaacaatactcttagcaacacgagatttaggatcagtgctggtagaaacagcatcatgagaaacactagcaatagtaataatgcctttagccacaatgaccttcaacagttctcttatgaacatcacccataactacaatggctccaggaacaatgcacttagaaataacttccttagcaacagtgaccttactatcgatgccaattgaaatatcatccttaggcacgtgttccatggaagcaacatcattagtaaccacagcttttgtaacaatgacttttagcaaaaacattagcatagtgccttaacaaaggcccttagaaacaatgcaactacaggccgggcaaggtggctcatgcctgtaatcccaagcacattgggaggctgaggtgggtggatcacttgaggtcaggagtttgagaccagcctggccaacatgatgaaaccccatctctaccaaaaatacaagaattagctgggcatggtagtgcacgcctgtaatcccagctactcgggaggctgaggcaggagaatcacttgaacccgggaggcggaggttgcagtgagctgagatcatgccaccacactccagcctgggcaacagagggagaatccatctaaaaaaaaaaaaaaaaaaaaaaagaaaagaaaagaaaaaggaaacaatgcaattatcatcaattcccttagcaacggatcctttagaatataatgctcttaacaacagcactcttagcaacaacatccttgacaacagtgtacttagcaacagtgcctttagctaaaatggcctttagtaaaatcaactttagcaacaatgcccttataaaagatgccccttgtaacagtgtccttagccagaatctctttaggaacaatgcctttaccaaaatgcatttaagttcaacggccttagcaacactgtccttggcaatattagatcttagtggcaatgctctcagcagcagtggtactcagcaatgatttctcttacaacacccttaacaacaatacccataacagcagcacactttaaaaaacaggcttagcaacaatgtccttaacatcaatgccttttggaacatcaaccttagcgacaactgcacttactaagagtgcctttagcatcagtccccttagcaataccaccattcaaaccaataccccttagccaaaatgattctaataacggcacactttattttctttttgacagagtttccttcttgttgcccaggctggagtgcaatggcatgatctcggctcactgtaacctccgcctcccaggtttaagccattctcctgcctcagcctcccaagaagctgggattacaggtgtgcaccactaagcccagctgattttgtaattttagtagagatggggtttcaccatgttggttggtcaggctggtctcaaactcctgacctcaagtgatccaccggcctcggccttccaaagtgctgggattacaggcgtgagccagcgtgcccggccaacagcacactttcaaacaacaccttaacatcaacatccttaactctctttgcaacaatacccttaggattaagtccctgagcaatagagtcattaacagcagtgtatttagtagcaatgcttctttactgtaatacacttaacaataatgaacatagtaacaatgcccttagccataaaggactttacaacaacaaccttagcaacgacactcacagtgacagtgtccttcaaatgagtttcttagaaacagtggtcttaggatcaacattttagcatgaatgctctttgcaacaattattctaggaaaagtgcttctagcaactagccctttagcaacaacacactgaacaagaatgctctagcaaaaatgtacttaataacaacatccttagcaaaaatacccttagcaaaaatgagtcttagtaacagagccttaatgtcaatgtccttagctacaatgcccctaatatcattgtcagagtgacaatatccttagcaacaataggccacatcaacaaaacacctagcagcaagttcctcagtgacaatgtgcttaatataaatatccttactcacaatgtcctttagcaactcttataggcaatggccttaacaataatattcataataatattttccttacaacagtacttaacaacctttgcacagcacccttggaaaaaaagccaatttagcaaaacctttcttggctaccaaccatagcaacaatgccctaagcaataacacctttagtatcatttcccatagaaacagtggctataaaacaaggccatcagcaacagcatgcttaccaaaaatatctttagaaacaatactcttggcatcaacaccttaaaaacaacctcattattataactgcctttaataaaaatgccatgaacaaccaggcccttagcattggtgcagtatcaacagtgaccttagaaacagcaccattaacaacaactctgtgagcagcactatttgcagcaatgtccttattaacaatgtatttagctagagtacccttagcaattggctcttagcaacatcacatttggaaacagtactcatagcagcagctcccttatcaacatcactcatagcaaaatctgttttattttcaacactcttactatcaaggcctttaagaacaatgactgtaagaaaatagcccataacaacaatttccttaaattcaacactctttccttaggaacagcacctttagcaccaatgatcttagcaacagtagcctctgcaatagtggccatggccacaatgttcttagtaacagcacctttagcaaaaacatccaacaacaacattaacatcaatgcctttggctgggcacagtggctcatgcctataattccagcactttgagaggtgggatcgggaggattgctttagaccaagggttcaagaccaggttgggcaatgtagtgagatctcatctctacaaaaagaaaaattaaaaaaattaaaaagctagctacatgatatggtttggctgtatctccatccaaatctcatcttgcattgcagctcccataattcccacgtgtaatgggagggacccgatggaaggtaattgaatcatgggggtgggtctttcccatgctgttctcataatagtgaataagtctcatgaaatttgatggttttataaaagggagtttccctgcacaagctctcttgcctgctgccatgtaagatgtgactttgctcctcttttgccttctgccatgattgtgaggcctctccagccatggggactgtgagtcaattaaatgtctttcctttaaaaattacccagtcttgggtatgtctgtattagcaacatgagaacagtctaatacactaggcatggtggtgtgtgcttgttgtcccagttgctttggagactgaggcaggaggatcactttgagcacaggagttcaagcctgcagtgagctgtgatcatgcaactgcactccagcttgggtgacagagtgagaccctgtctcaaaacaaaacaaaacaaaacaaaaatgcctttaagaacagcatgtttaacaaaagaacctcagcaatgacttccttagccacaacaaccttggcaaaaatattattactaccattctcttagcaattaagtccttaggaataatgctctgagaaaaaaagtgcttttagcaacagtttccttagaaacactagtcatagcaataacacccttagcaaaactttctttgcacaataacttcaaggccttaaagaacaatgcccttacaaaacttttttgacatcaacacctgccttataccattttgtgttgctcaaaataaatacctgaggatgggtaatttatacagaaaaaccatttagttggttctcaattctgatggctgggaagttcaagattggacatctgtgtcaggtgagggcctcaggctgcttccactaatggcagaagatgaaggggagctggtgtgtgcagagctcacatgatgagagagagagagaaagagagcagaaaggtctcaggctctttttaacaaccagctctggcaggaactgatagatgatacactcagcctcaaggaaggagattaatctgttaatacgggatttggtcatatgacccaaacacttcccattaggccccatctccaacattggggatcaaatttcaacatgaggtttagaggggacaaacatccaaaccatagcaatacccttaagaacaataaccttaccaatagtacccttatcaaaaatgcccttaacaacagctttcttagcaacagtacagttactaacagcactcatagcaaaaccttaatcttcaataacacttttaatatcaatgcctttaagaatgacaatcttgaccagatatggtgactaatgtctgtaatcccagcactttgaaaggttgaggcaggaagtttgcttgaggccggcagtttgaggtcagtctgggcaatatagtgagatgctgtctctacaaaaaatttttttaaaaagtccggtatggtgacctgtgctcgtagtcctagctacttgggaggctgaggtgagaaaattgctggagcccaagagtttgaggttagtgaaccatgatcataccactgcactccagcttgggcgacagagctagactctgcctgttttttttaaaaaaaaaaaaaaaaaaaaaaaaaagaggaccttcaaaattgcttccatcaacaattacctttgcaaactttccatcagcagcaatgctcctagcaagaacatcttttgcaacaatgcttttaacatatctcattttgcaacatagaaacaaacgcagttaggaacagcatccttaacaacaactttctttacaacgatattaacacaagagtcttgcaacacccttaacaacaagtttcctttgcaacagggccataacatcaacactcttggtaattgcattagtaccaaaacttatctgtgacaatatcttgaacattaatgcctttaagagaaatgcccttaaaaatacctttagcaagcatttccttagcaaacacgctcctagcaacagagagtaagttttgtaagggcatgtgaatacgaaggcagagactggagtgatgccaagaaatgtgaaagatttccaggagccatcagaagcaaggaaaaacgcatggaaaagattccgagtgctcagaaggaagcaaccctaccaccacctgatttggacttctaagctccagaactgtaagagaaatttcttttattttaagccacctcgtttgtggtactttgatatggcagccctaggaaactaatacaattctcttaacaaaaaggcaacaatttccttagcaataataaacttagaaataatgccttctcaacaatgactttgccaacagtggccatagcagccacaccctcagcaaaagcaacttagtgcagatttcttagcaaagcacgccaaaacacactaacaaacatactaagaaaacacaaaacacactaatactaacaaagaaagtgcctttctaaaaactgcctatcaacaatcttatcaacacatttcatagcaaaaatttccttagcacctttgcccctagcaatgttgcctttagcaacagttttcgtggcagcagtgaccatccaaccttgatttagcaaatgcatccttagcaaaaactttcttgcaacaccacccttaatactaacacctttaagaacgatgtctttagcataagggccctcccaacaatatcattagcaaaaacttggcaaaatgtgcttagcaaccgcactctttgaaaaagttccattaatagcaacatacttaataacaatgtctttagcaacagtggtcataggaattgctccttctgcaagagtggctactgtaattgtgaccagagcaataatggccatatcagccatgcatttagctacagtggcagtaacaactatgtccttggtgacagtatgtgtggggaacatttcttagcaacaacacccttatctaagaggccctaggagcaaaatccattgcaacactatatgcagcaacaatgtccttaattattaggttgatgcaaaggtgattgcggtttttgccactgaaatggcaaaaatcgcaatcacctttgtaccaacctaatacaattcccttggcgacaatcttagcaacaacacccttggcaacaaagctcttagcaatatccttagaaacattgtctttagcaacatttcttagcaatggtgcccatagcaacagttccctagtaacagcaaccttagaagaaactccctttgcaagagcacatttaacatcactgcctttaatgaaaaaccacttaataaagaagtcctggctgggcgctctggctcacgcctgtaatcccagcactttgggaggccgaggtgggcagatcacgaggtcaggagatcaagaccatcctggctaacatggtgaaaccccgtctccactaaaaatacaaaaaattacctgggcgtggtggcaggcgcctgtagtcccagtactcgggaagctgaggcaggagaatggcgtcaacccgggaggcggagcttgcagtgagcggagatcgcgccactgcactccagcctgggcgacagagcgagactccatcgatggcctgatggcctgcaggtgtctgttggcctgctcttccgccagtgtgctttcgatgaccagctgcttgtgtcttcttctgctgatgtgttccttatgatgtccagctgcttgcgtccctgccttgctaaggtctctggtttttataggcccatgatgggggcatggcaggccagggtggtcttggaaaatgctacatttcggcatgaaagcagaagtgcctgtccttacctaggtccgtgggggtggagccctagccagggaccatgccctcctctacccagcacttcccttctccccttccctatcatttaaagggaccacgctcttcccttcccagcacttccatatcagtttggtacacaggtaaacttgtgtcatggaggtttgttgtacagattgtttcatcatccaggtattaagcctaatgcccatttgttatttttcccgttcttctctctcctcctatcctccaccctaatgtttccctctgtgtgtccgtatgctctcatcgtttagctcccactataagtgagaacatgccgtatttggttttctgttcctgtattagtttgttaaggataatggcctccagctccattaatgtttgtgcaaaggacatgatcttattcttttttatagctgcatagttttccatggtgtatatgtactacattttctttatccagtctatcattgttgggcatttagggtgattccatgtccttgctgttatgaatagtgctgcagtgaacatatgtgtgtatgtggctttataataaaatgatttatgttcttttgggtatatgcccagtaatgggattgctgggctgaatgacatttctgtctttaggtctttgaggaatcatcacactgtcttccaaaatagtagaactaatttacactcccaccaacattgtataattgttcctttttctccacaacttcaccagcatctgttttttttttttttttttgctttttgctttttaataatagccattctgatgagaacacatggacacatagagggtagcaacacacactgtggtatctcaaagggtggagggtgggaggagggagaaggtcaggaaagatacctaatgagtactaggcttaatacttgggagatgaaataatctgtacaataaccccccatgtcacaggtttacctgtataacaaaccttcacatgtaaccctgaacttaaaataaaagttaaaaaaataattaccaattaaaagaagaaatttcaggtttttaaaaagaaattgtaacagttctgctgaacaatgtttcaggatatcattttctcttagaaaaacatgtattctgctgctgttgggtggagtgttctataaatgttaggtatagtttataatgttttattattttaaaaaatcaccattctgactggtgtgagatggtatctcactgtggttttgatttgcatttctctaatgatcactgatattgagcttttttcatataattgttggccgcatgtatgtcttcctttgaaaagtatctgttcacatccttttctcactttaatggggttggttttttcttgtaaattagtttaagttccttatagatgctgggtattggacctttgtcagatgcatagtttgcaaatattttcttgcattctgtaggttgtctgttgactctgttgatagtttcttttgctgtgcagaaggtctttagtttaattagatcccatttgtcaatgtttgtttctgttacaattgctttttgtgtctttatcatgaaatctttgcctgtgactgttctgaatggtattgcctaggttgtcttccaggatttctatagttttgggttttacatttaagtctttaatctatcttgagctaatttttttatatggtgtaaggaagaagttcaatttcaatcttctgtgtatggctagccagttatcctagcaccatttattgaatagggaatattttccccattgcttgcttttgtcaggtttgttgaagatcagatagttgtaggtgtgtggtcttacttgtgggttctctattctgttccattggtttatgtgtctgtaccaataataaatttgtacaaataaatttgtaccagtactatgttgttttggttactgtagccctgtagtatagctcaaagtcgggtagcgtgatgcctccagctttgttgtttttgcttaagattgccttggctattcgtgctcttatttggttccatatgaatattaaaagagtttttttatagttctgtgaagaatgtcagtgatagtttaacaggcatagcattgaatctgtaaattgcattgggcagtatggccattttaacaatattgactctttttttctctctctctcttttgagatggagtctggctctgtcgccaggttggagtgcagtggcacaatcttgactcactgcaacctccgcctcccagattcaagcgattctcctgcctcagcctcccgagtagctgggactacaggcgcacaacaccatgcccagctaatttttgtatttttagtagagacggggtttcaccatgttggccaggatggtctcaatctcttgacctcatgatctgcccacctcagcctcccaaagtgctaggattacaggtgtgagccactgtgcctggccaacaatattgattcttcttatccatgggcatagaatgtttttccatttgtttgtgccttctctgtttatttgagcagtggtttgtagttctccttgtagagacctttcacctcccttgttagctgtattcttaggtattttattctttttgttgcagttgtgaatgggagtttgttcctgatttggctcttggcttgacttttgttggtgtataggaatgctagtaatttttgcacattgattttgtatcccgagattttcctgaagttgcttatcagcttaataagcttttgggttgagactatggggttttctagaaatatgatcatgtcatctgcaaacagggataattgacttcttctcttactatttgaaagttctttatttctttatcttgcctgattgccctggccagaacttccaatactatatttaataggagtagtgagagagggcaaccttgtcttgtgccagtttccaaggggaatgcttccagcttttgcccattaagtatgatattagctgtgggtttatcatatatggtgcttattcttttgaggtatgtttcttcaatacctagtttattgagagtttttaacatgaatgaatgttgaattttattgaaagccttttctgtatcttttgagataatcatatggttttggcctttagttctgtttatgtgatgaataacatttattggtttgtgtaggttgaaccaaccttgtatcccggggatgaagtctacttgaccgtggtggatacgccttttgatctgctgctcaattcggtttgccagtattttgttgaggatttttgcatcaacattcatcaagaatattggcctgaagttttttgttgttgttgttgttgtatatctgccaggttttggtatctggatgatgctggcctcatagaaggagtttgggaggaatccctcctcctcaacttttttgaatagttttggtatgagtaataccagctcttctttgtacatctggtaggattcagctgtgcatctgtctggtcctgggccttttttggttgacaggctacttattactgattcaagtttggagcttatttttggtctgttcggggactcaatttcttcctggttcagtcttgggagggtgtatgtgtccaggcatttatccatttctactagattttctagtttatatgcatagaggtgttcataatattctctgagagttatttgtatttctgtggggtcagtggtaatattgcccttgttgtttctgattgtttatttgaatcttctttcttttcttttttgttagtctagctagtggtctattttaattttttcagaaaatcatctcctggatttgttgatattttgaatgtttcttcatgtctctatctccttcagtctgcctgtgtgcagttctagtttcagtctgttttagagatcaagcttgaatacataagaagaaagaagaagactgagaagaaggagaaggaggggtggaagaggaggaataagagaggagaaataagaaggagagagagagggagggaggaagaagggaaagaggaaggatgatgagagggaaggaaggaaagaggaagggaagaaaggaggaaatcaagttaggcaaatcaccgctaggtcatccttcaggtcctgagctccataccaagttcaggggtacatgtgtagctattgaaatgggaaaggttcccttgtcccttttgcagggcatgtgatggaggtgtggcttgcttcttcagtgcttcagtgccccgctggtcaaacctctaggggagcatacagacaggctgtggggcttcaaccccatggcaatgtctaggggtgaatgtttactactcttatccaacgttcagagtcttctgttagtaacattatgcattttgaccatgattatcagtgtaatcagtagataaggcagaatgtgtttactcgatctgaaccaaactggaactctgcaattgggatgtgtgcaactgtgcaccttcaaaatgtccatgttgaaattttagagcaactgattaatatgaccaaaagtacttaagagaaaagtttcaaaacactaattctaattataccagctcttgttcttttttatgttcatgcttaatattttctttctttatttattttattttttatttttttgagacagagtcttgctccacccaggctggagtgtagtggtgcaatctcagctcactgcaatctctgcctcctgggttcatgcaattctctgcctcagcctcccgagtagctgggattacaggtgcctgccaccggtcgtaactagtttttgtatttttagtaaagatggggtttcgccatcttggccaagctggtcttgaactcttgacctcataatacacctgccttggcctctcaaagtgctgggattacaggcatgagccaccatgcccagccatacttaatattttaatttcaaattttatatatgaatgtatgtatgtgtcagtatatatattctatgtacatattgtgtgtgtgtgtatatatacacacacacagagagagagagagagggaggaaggatataaaaattatatcaaagaagaatgtagtgctatttaaaccaaagaacacacgcacaactcttactattataatcatagaaaaaaattaactgacattaaagggcattttaaatgttcatatattttgtctcttttactcagctactaaaatactcaaaatgtggtaagattctctaatgtttatatagtagaggttttttgtttaactagttgagttggattgcttatcatacaattgagagcttcgaatatcagaacagttacttacatgccaaaattgcttatgaatgttctgtcatgtcaaagttgttccattaccatatagaagtaaactctgatctgtatagatactaccagatgggtgtgttggcacatgcctgtagtctcagttacatgggaggctgaggtggaagggtcacctgagcctgggaggttgaggctgcagtgagctgcgatcacaccactgtactccagactgaatgacagagtgagaccctgtctcaaatgaaaaataaaatgatattactagaatatacttgtctaaacttttactttgagaaaacagaaaatcaaacacattgttctcacggtgttaactttcaaagaaatgatctgtaatttatctggtggaattcaatgcagttattttgtttataacatttttcaaaagctacggttttccctgggtgtgtatgggcacaatgccattgcgataacactcatcttttgcagagtgctgaaagagtgagccaggacagcctttcgacattgaacaaggcaattcccaatctcttggtgggtgaatggaggaagagtgatatcctgattgatgcctccacaattacttaaaaatatatggacactctagaaaattactctttttggaccatcccctcaggtcccttaaatatctgtgtcccttaaatatctgtgtccctttactgagcagcaatttgggtcagaaaaaatgggctctgaggatgctcagaaacaaaagtgttttggggagtaagatatggttctcaaggcctggagaggcaaaccatgtccagaaaaggtccctgatgatagaactccctgagtattcttgcagaaatgaatatccaccaggcttcttctttttttttttttttttttttttgagatggagtctgtctctgtcgcccaggctggcgtgcaatggtgcgatcttggctcaatgcaagctccgcctcccaggttcacgctattctcctgcctcagcctcccaagtagctgggactacaggtgcctgccaccatgcccggctaattttttttgtatttttcgtagagacggggtttcaccgtgttagccaggttggtctcgatctcctgacctcgtgatccacctgccttggcctcccaaagtgctgggattacaggcgtgagccactgcgcccggccccttgtttttcaatcacaagatatgagtcattgcaggaaacaaataaaatggaaccaacacagagaaaggtagagatggaagaggtaagactaaattctagagatgctgcttatgccctaaggtctgtcctttagcattttgtaacatgagttaaagtacgtttgagttgtgtctttgtcatttgcatccaacagagccctggctgtgttcactgaatggatctagtctctgaaaattcaccgacatttttggcttggcgctgtggctcatgcctgtaatcccagcactttgggaggttgagacgggaagattacgaggtcaagagatcaagactatcctgggcaacatgatgaaatgctgtctctactaaaaacacaaaaaattagctgggtgtggtggtgcgagcctgtagtcccagctactcaggaggctgaagcaggaggattgcttgaacccaggaggcggcggttgcagtgagccaaggtggcgccaccgctctccagcctggcaacagagcgtgactccgtctcaaaaaaagaaaaaaaaaaaatttcagggatatttatgtagtgacctgttatttaatttttcaataatataaatctgtttcaagaaaaagaaattttaaataaactcttatgattttctttctcctgaaaattattccagaacttaaaaaaaagaagaaacaaaacagagtaagtacattagctttattcaacatagcatcttgtctagtagtaaactactaaaaacagtctcctgagtggaaaaaatataaatttttgtctatagcatcagcgttgtcctgcatgttctcattattttctccaaataaattggctcaatatgctgctaagtattaccatttatgtttattttgaagttctatatcttgtctttcctgtttcatctgtaaacaggcaattattgcctcagtgtgtattctgatacattttctctctaaatctattgtccaacatcttgcatataaaatctggcttttctctcatatatcaaaatcacaggtcacatagtctcagtgccaagagttataagaacaactgctttatttcactcctatctctgtgaatacaaaacttcaatctctaaagtattttctatctatttataacactatgttcctggtttattattatattatttcattattagttcttaaaaacttaacaaggtgctgaataattttgtgaaatattccatggagaactaccattaaaatagtgattactttaattatatttcatcacctcatttcacaagtcattacaaaacttcttaattgtttaaaaatgaatgtacttgggtggggcacagtggctcacacctgtagtcccagcactttgggaggccgaggaggccagatcacccgaggtcaggagtttgagaccagcctggtcaacatggtgaaaccccgtctctactcaaattacaaaaattagccaggcatggtggcacacgcctgtaatcccagctactcaggaggctgaggcaggagaattgcttgaacccaggagatggaggttgcagttagccgagatcatgccactccagcctggccgacagagcaagactctaacaaaaaaaaaaaaaaaaaaaaaaaaaaggaatgtgcttatcagtccaagggaaataactatcaaattagtcactgcccaagtgtacgtcttttttagtgaacacaaattgagaatttagcactgaatctccaaagatttagtttttatctaggttttgaaattgaattttgttttgttttgttttttgttttgagacagtgtcgctctgtcgcccaggctggagtgcagcggcgcaatctcggctcactgcaggctccgacccccgggttcacgccattctctcgcctcagcctcccgagtagctgggactacaggcgcccggcgaattttttgtattttttgtagagacggggtttcaccgtgttagccaggatggtcttgatctcctggcctcgtgatccgcctgcctgggcctcccaaagtgctgggattacaggcgtgagccaccgcgcccagcctgaaattgtattcttaagtctcagaaggctgaagctttcaagacaggaagaagacagggattcccgagttgaacagagagtgggccgggcgcagtggctaaggcctgtaatcccagcattttgggaggccgaggcgggtggattccgaggtcaggagatcaagaccatcctggctaacacagtgaaaccccatctctactaaaaatacaaaaaattcgccgggcgtgggggcttacgcctgtaatcccagctacttgggaggctgaggcaggagaatggcgtgaacctgggaggtggaggttgcagtgagccgagatcaggccactgccctccagactgggcgacagagcgagactgtgtctcaaaaaaaaaaaaaaaaaaaaaggccgggtgcggtggctcacgcctgtaatcccagcactttgggaggctgaggcgggtggatcacaaggtcaagagatcgagaccatcctggccaacatggtaaaaccccgtctctattaaaaatataaaaattagctgggcgtggtggcaggcgcctgtagtcccagctactccggaggctgaggcaggagaatcgcttgaacccgggaagtggaggttgcagtgagccgagatcatgccattgcactccagcctgggcaacagagtgagacaccctctcgaaaaagaaaaaacaaaaacaaaacaaaacaaaaagatagtaaacaagaaaatactaatgtagttgttaactttgagaaggcagtaatttaagacatggatgtgaatgcagataatggaagtaaggagagatcagtgtaggccacagtcctgtgctgagtgctgtctttacctgtcttgtagggatggctcagacaaagtcttaacaaacaggcaaatgactgatttatctttttagattctaaagttcataagaataataatgagctttatagttgacaatagctaactaaaatttggtctaaggggaaaagagcgctcaatgttaatcagtcagtttaatctttctgtaaaccctctcaaaaagcaaaattaaattagatcattgtggtgcacagattcttttggtatgtgtgtcccacctataataaagttctgggccaggcgcggtggctcacgcctgtaaccccagcactttgggaggccgaggcgggcggatcacaaggtcagaagatcgagaccatcctggctaatgcggtgaaaccccgtctctacttaagaaatacaaaaattggccggacgtggtggcgggcgtctgtagtcccagctactcaggaggctgaggcaggagaatggcagagctttcagtgagccgagatcacaccactgcactccagcctgggcgacagagccagactccgtctcaaaaacataaataaataaaataataaataaataaagttattggccaggagcagtggcttacacctgtaatcccagcactttgggtggccgaggtgggtggatcacctgaggtcaggagttcaagaccagcctggccaacatggtagaacttccctctctactaaaaatacaaaaattagccaggcatggtggcgcaaatctgtaatcccagctactcaggaggctgagacagtagactcgcttgaatccaggaggcagaggttgcagtgggccgagattgcaccactgcactccagcctgggtgacacagtgagatgccgtctcaaaaaaaaaaaaaaaatttatctgaggactgaccccacaatggtgagccctgcctgccatgtttgtgttatggaatcatgtcccatacctgaccctatttatttaaaggtagaacaactgacccaaccacattttctctttaaaaagtgggaattgggattgagagatactggtctttccctatgggtcatttcaacttagaatatttaagtttgggatcgttggtgcttccatatttaaccagcagcttagaaaagcagacatagtcaatctgtggaaagaaaagctgaagtgatgtggagagagaagttgtgaaaagcgatcagagcgcctgggagagatttacttagggtagctggagctgttcctggagctctttccagactttggttctagctcttgaagctaccaggcttccagcctttagaataattccattttaacctcagagattttgcgctggttcaacaccaaacaaaagaacactgaataagacagtaatgtgagtagaaaattctatgaaatagaaaagaaacttaatgatgcgtcataggccattaatattcactttcctccgtcccatgtatatagatcacttcgcctcttccaaaattcttatttcataataaagattaactagttatttaaaagttaaccatagcctatttattgtttattaacaaatgtgtttaaaaggatcaggtgctaaaccttggaagaatattaaggcaagatgttatgagatcacagaagcttagtgctgaagggtgcatgccttcacgtgggtacagattcctctccgagtgctcattcacccattgtggtgtgagccctgtgtgaaaactcttcagacgcagacatgaataagacaaggtgtctgctcaaagtcaactagaggagacagtaagcaaataattagaatgtggaacatgccataatcgaagtggatgggtgtcatgggagcacagatcatggggtatctaactttgctttggaggttaaagtatagcagtcgtgaagacttcaaaggggaggtggatttttattggaactgttgagaataaacaaggatatacatactttcacctatggcctgagggtatatgagctttaagagctgaactgttgggggcattccagaccaagaggaagtcgtgggcagaggcaggaaggtgaaaggagtatgctgtttttgggagaagcatagttagtgcagaggggctatgactcagggcacacagggtggcagagtgtgtccgggagatgaaactggcttacaggcaggaagtgaggaacaaaggaccttctgaacttcttatggaatttagacttctatagataacagagaatcactgtatgaatacactgtcatacattctttgagagaaaacacattcatttttgagaatcctcattcctgagttcttctttttgtctgtggtacagcttcctgcagccccatccaccaattacagacctatcttcttagtgtgagtctaatgtctcctccatgggagggagctgtagaatttaaagttgaccatcctgctcatgcctgcgttttctctctcctgcaactaatgccttcctctctgtctgagacctggcatgtcagggtagaaggcccttcaccctccttctcttgacaaactctgatttattgacatcttactgaatatccaatggctggaactgggatcaagctcttcagtgtggtctaaaagctgggggcaggagagacctcactcccttcaaactcactaagatatgaggtgacctcattataccacaggcttttgtcaaggccacagggacataaactcaggtcacttttgtttcacaagcgttattctaatatttgtgtttttttgtttgtttgtttgttttttgagatggagtctcactctgtcacccaggctggagtgcagtggcacgattcggctcactgcagccccgcctcctgggttcaagcaaatcttctccctcagcctcccgagtagctgggagcacaggtgcataccaccacgcccagctaatttttgtatttttagtagagacagagtttcaccatattggccaggcaggctggtctcgaactgctgacctcgtgatcttcccacctcggcctcccaaagtgctgagattacaggtgtgagccaccacgcccagcctaaatttgtgtatttttaaactaaagtgtcaaactacatttatcgccctcttcttagtttggaaaagtgctttgtttctgttaagattgttttaggttttatctcttcaccacacacaggctgctccttccagttcagtattagctgaggatttcatttcagtcctcatacagagcagtgataacagctgaataaaccagagctgaaagtgggcccatgtccctctttcctacctttctttcacacctgagtctgattgagtgcagtatgcaacttggatgagcgtgtgtatgcaaagtgcacgtcagcaatgaccatagctggaacaggatggagctagccacctctttatcatctccctgctcattctttgatgcagaaaactaaccttgtctcaagcacgtgtaaataattcatgcaaagttacaagacatggttcaagtcatgtcccctccaaccacatcagcaccatgagcagtccttgagggtcttcagataataacaacactaagagttagcatatgttgaatgctgtactatgtatatcattctaaggggagaagctatgtagaaccaaaagtaagcacaggcagcttcaagcagcacagagaaacacaacacaggaggtggcttatttgattgtcattgaagttgtgaaaaagtgttaaaaacaataaatacaatagtttaaaaaagaaacaaggaaagtattatataccataacaaagtgggatgtactccggaatgcaagcctagttcaacagtcgaagatcagtccattataccaatgggttaaagaagaaaaatcatgtaatcttatcaatagatgcataaaaagaatttgacaatatctaacaatcattcatgataaaaactttcagcaggctgggtgtggtggctcatgcctgtaatcccagcactttgggaggccaaggcaggaagatcacgaggttaggaaatcgagaccatcctggctaacacagtgaaacctcatctctactaaaaatacaaaaaaaaaaaaaaattagccgggcatgatagcgcgtacctatatcccagctactcaagaagctgagacaggagaatcgcttgaacccaggaagcggaggttgcagtgagccgagatcacaccactgcactccagcctgggggacagtgtgagactctgcctcaaaaaacaaaacaaacaaacagacaaaataaaaactttcagcaaactagcaatagagagaaacttcttcaaattgattttttaaatctaaaaaacccctccacttaacatgatactcaagcctgaaaagtgagatactttcccactaagaacaggaacaaaacaaggatgtctcctcttatcactcttatttaactttgtgtggaaagtcctaactaatgcaataagacagaaaaaagaaataaaaggtatacagataagaaaggaagtgatagcggggcgcagtggctaacgcctgtaatcccagcactttgggatatcgagggaggcggatcacgagaccaggagatcgagaccatcctggctaacatggcgaaaccccgtctctactaaaaatacaaaaaattagccgggcgtggtggcgggtgcctgtagtcccagctactcgggagactgaggcaggagaatggcgtgaatctgggaggcagagcttgcagtgagccgagatcgagccactgcactgcagcctgggtgacagagcgagactccgtctcaaaaaaaaaaaaaagaagaagaaaggaagtgataaaactgtctttgttcatatatgccatgagtgcctatgtagaaaatcacaaagaataaacaaaaaactcctagaatgaattctatgtatataatcttttataagtgattacagcaaggatgaaggatacaaagttaatttaaaaaagtcatttctttttctatatgccatcaatgaacagttgaaatttaaaattaaaaacacagtgccatttacattagcaccaaaaatgaaatacttaggtataagtctaacaaaatatgtgtagtatctatctgaggaaaactatgaaaatctgatgaacgaaaccacagaagatctaaaaaatcgacttactgcatgttaatgaataagaaaattcaatattgttaagatatcagttctttcaacttgatctacagatcagtattgggatcaatgcagtacttatcaaaatccaagcaagctactttgtagatattgactagctgactccaaatctatagaaagtcacgagatgcagaaaagccaacataatattaaagaagaacaaaattagagaactaatgcttactgacttcaagacttactgtaaacttacagtaatcaagagagtgtggtattggtaaagaatagacaaatagatcaatggaatagaacacagagtacagatagagaccctcacaaatatagtcaatagatctttgacaaataagcaaaggtaattcaatgggaaaaagatatgcttcttaacaaatggtgttaaaactactggacaaccacatgtaaaaaaatgaatctagatactgaccttacacttctcacaaaaattaactcaaaatggatcatagacttaaatttaaaggcaaaactataaaacttctaaaagatagcaggagaaaatacaggtgaccttgggtttgactatgagtttttaaatacaaccctatagtgtgacctatagaagaaaaacttgctaagtgggactttattataattaaaaaaataaaaaaacttctactgcatgggtgacactgttaaaagaattagaaaacaagtcacagggagggagaacatatctgataaagggctagtattcaaaatatacagagaatacttgaaactctacaataagaaaacaaataatccaacttaaaagtgggcaaaaggccgggcgtggtggctcacacctgtaatcccagcgctttgggaggcaaaggtgagaggatcacgaggtcaggagttcaagaccagcctgaacaacacagtgaaacctcatctctactgaaaatacaaaaattagctgggcctggtggcacgtgcctgtaatcccagctactgaggaggctgaggcaggagaattgcttgaacctgggaggcggaggttgcagtgagccaagatcacaccactgcactccagcctgtgtgacagagcaagactgcatctcaaaaagaaacaaaaaaaagtagctggaatcatacagtatatatgttgatattatttttccagctatattataaactccacatgggcaacgtatattccctaccttatataatgtataatatatacaatatgtacctggtataatgtataatatgtacatatttaataaacactcattattataaatattcacaaataaatatacataataaatgttctctaatcaaccacatagagttttttttaacacctttgaataatgcaataggaacaatctattaaaataaaacagaaaaatattcaaatttaaatgaaacaaagcaactgccaaattattaaatccaagttccttatcttaggggtcaaatgcaaatattcttatagcttttattgcacatacatgttggcggtcatggtaaaagaagatacaactctcaacttcaataaaatgtatttcaatattcaataaaatttcaatattataaggaaaccaaaatgttgtgttagtaccaggacagttgcgtgtgtaggtacttgtgatttctttttctttctttcttttttttttttctgaaatggagtcttgccttgttgcccaggctggagtgcagtggcgccatctcagctcactgcaagctccgcctcccaggttcacgccattctcctgccacagtctcccgagtagctgggactacaggcgcccgccaccatgcccggctaattttttgtattttttttttttagtagagacggggtttcaccgtgttagccaaggtggtctcgatctcctgaccccacgatccacccgcctcccaaagtgctgggattacaggcgtgagccactgcgcccggcccatacttgtgatttcacgtgcacagtgagagtttgactccttcatcctcgcccaaatactttttcatcccatgactgttgggcttttttttccctttctttctttcttttttttaagattgcaactctatcaatactgggatgtctattcaagctagctaaatatgttgattaacttctccactcccagcacctcctagaatcccactgcaataacaacaaataagaacaaaggggccgggcgcagtggctcaagcctgtaatcccagcagtttgggaggccgaggcgagtggatcgcttgaggccaggagctcaagaccagcctggccaacatggcaaaaccccgtctctactgaaaatataaaaattagccaggcgtgttggtgcgcgcctgtaatcccagctactcaggaagctgaggcaggagaagagcttgaacctgggaggcggaggttgcagtgagcccagatagcgccagtgcacaccagcctgggccacagagtgagactctgtctcaaaaaattaaaaggaacaaaatgaacccatttatacaaagactacaagggtggagagacttggatagcatgcaggatattcacaagcaattctggaagaaaaatggcagatgagtgcattctgttattaaaatcacagctcagagtcctcccaggaaatggctgcggtgtgtagggagctgtctttcacagtgatgaaaagaactctaggttcagagtgggcaggtatctggaagaacattttttcgccagcatccctttatttattgatacgtcgatgagaatagtaccacagcccaatgacatttatcatttcagttggcagtgtctctgagagcaagctgcaagatttccaagccttcactgagtcttctactgacatttagcttaatcttgacaagtatatctgactactgcaatgtgttaatgatcaaggagtatgtcaaattataacatgtctgctgcaggaaattatggggcaatacagacagtgtgcactggatcaaccattatctatgcctggtgttatgacaaaaagtgattgattttggcatcaaaattaaagtgttcgtctggttcaacttgttctttgtacaccgtccttcattatgacaagcacatatagcaaaaatactgtcttcaatatgaactgttgattattgattaaacagatcacatttggatgggctgctgtttctgcatgtctaacggatgggatccttctgagaatgctagagtagggaatcatgacaccgagccacttcagtcatagaccttattcttgcacttttttttcttgctggcaattttacatagcaggttgagaaagctactctatgctagtatagactatacaccaataattttgataatgagttccaggatgtatttttcttcttatatattttccttcctaccatgatactagtaatttataaggggtctgtgtagtttgaatgtatttgaataactttagctctactgtttgatttgacccaaagaagcgaagaggacgtaaatattcccatttagaagcccaaagtcagtgagatgaaacccaacattaagaaattgaagcaaagttacttgtggataaacaaagcattaggtaagttgtctagagcataataattagatttactggctttcaaaaatttggattgcaataagaggaaacttcatgctatttttacaattttcagtacaaaggggtgtatatctagaaacaataaagttgtcatatttgagtaccttttcaaaaaaacgtaaccataacctatttttttttttttattaaaaggaccaggtgctaaaccttggaagaatattaaggcaagagtattaaggcattttaattcagcttaagtatcatgttaagtggtgaaattcagatgtaatagaatgcataaaagtgttaatcaccagtgcttaagatggcccacagaggttgttctaccaggcatatagaaatctttctcactatgcctgtttgtgagcaggatcagtggttttgcactgcaggcacacatttcattttgtcaaatatttttgcaacctcccctctacttaatagtttaatcactacatctatacaaactacttggtcaatgagggcccattttacttgtgtcttccagaaatattttgcattaccccaaatgacatcttccagcagatcttcctcagatataaagtttccaaaaaactggcaaataaaattactatcttcagaacttttctgtatttaaaaataacaataaaaagctatgaatttacataaaattcaaaccattgtgtttatagccacagtcctccacacaattttcatgagaccattggtaaaatcatgtataagcaacattcctttattcctagaaagtgtttatatttcaaaagcactttatttttcctcagatattcccctgaagaaatttggaaagaaattgaaattgcctgtggttgtagccaattcacctgtaaagaatataaaattctccccatgaactggtcatcccagtgtcacacttacaagtctgagaaaagtgcaagaggttattcggaagtattccttcctttttcaattttctctttaattagaataattggtaagaactagcagaattggtatcatgtttttcttaaatgtttggtagaattcttcactgaagccatttagacctagcattggagtctttgtggaaaggttttaaattacagcttcaatttctttaatagataccgggctattctgtctgtttgtttttgagtaagactagataattgtgtctttggagaaatttgtccacttcatctaagttgtcaaatctgttggcacaatgttgttcataattaccatttattatctcttcagcatctgttgaatctgttgttatgttacttctcttattcctgataggttgtttttgtattctctctttttttcctgataagcctgaatagaagtttatcaatactatggaccttctcaaagagacagagtttggtttcatttatttcctgtaaatgatttttcctgttttctattgcattgatttctacactgatgctttttccttcctttcttctgcttactgttggttttattttcttttctagtttctttttttttttttttttttttttttgagatggagttttgctcttgtagcccaggctggagtgcaatggcaagatctcggctcaccgcaacctccccctcctgggttcaagcgattttcctgcctcagcctcccgagtagctgggattacaggcatgcatcaccacacccggctaattttgtatttttagtagagactgggtttctccatgttggtcaggctggttgaacttctgacctgaggtgatctgcctgcctcagcctcccaaagtgttgggattacaggcatgagccaccatgcccagcctcatacctgattttattgtgctttgctttactgcacttctcagatactgcattttttataaattgaaggcatgtggcaaccctgcattgagcaagtctatcagcaccattttctccaatagcatgtgctcactttgtgtcactgtatcacatctggtaactcttgcaatattttaaatttgtattattatgtctgttatgtgatctgtgatcagtaatctttgatgttactattgtaactgttttggggtgccacgactgtgccaatataagatgacaaacttgccagtaaatgtgtgtattctgaccgctccaccgaccatcccccatctcttttttcctctcttcaggcctctgtattccctgaaacagaacagtattgaaattaggccaattagtaatcctacaatcgcctctaagtgttcaaatgaaaggacgaatcacgtatttctcactttaagtcaaaagctagaaatgattgagctgagtgaggaaggcatcctggaaaccaagatagacgggaagctaggcctctttcaccaaacagttggccaagctgtgcatgcaaagagaatgttcctggaggaaattaaaagtgctactccagtaaacacacaagtgatgagaaagtgaaacagccttattgctgatatggagaaagtttgagtgctctggacagaaaatcaaaccagccacaacattcccttaaaccaaagcctaatccagaggaaggccctaactctcttcagttctatgaaggctgagagaggtgaggaagctgaagaagaaaagttgggaggtagtagaggttggttcgtgaggtttaaggaaagaagccatctccgtaaattagcttttaaaacttttttaagcaggcaatctctgactttgcttcagtaacatttccttctcctgctctttctcattttcccattgctcatgcttatacctgcccatctttctctagtattaaagtttggataaatgtttgatctttgaataatattttatattgttatatgcctctgattttatcctctggacaaacttgagagacagtgcaaaaatttctttatatctttataatataaagaattatggcaaattttaaaagaagtaccagctttattgaggtataatttacgtataataaactgcaccctctccaccccctcccctcactgtctaccaaaaaatgtctgatgatatcctggcaatctgaccctgcctggaaaacaccatagagaaagacagcaatgtgcttcctcactctggagttctattggattttaatggccatagatgtattatgagccacacaaaccagcactaaagtagagatttttttccagaaaaggtgtgctaaaaaagcatgtaaatgaaagcttttatttgttttattttcagcaaccaagacataaaattattaggtaggccatgatacataaacactaaccactgtaccatcctttgatgttcattgcaatggattcaatgtttgtgccccccacacaaattcatatgttgaaatcctagcccccaaagtgatgagattagaagggagaattgctgagaagtgattcagtcatgatgggccctgggaaatgggattagtgctcttatcaaagagactaggagcactggcttgcccctatcaccacatgaggacacagcaagaaagcacccatctatgaaccagaaagcaggccttcaccagacactgaatctgacaatgccgtgatcttggacttcccagcctccagaacgataagaaacacatttctgtggtttataagtcacccggtctatggtattttgttgtagcatcccaaatggacgaagacatagttcactgtcagttcaattgaccatgaaggattatggggcctgtgtgtccctggcactgtgataggaaccggggagaacacagagggaaattaataatacttcagcctgtattttaataacttagagtttagtagaaataaactgaaaggcatagcagggtgaaaaaaaaagtgtaagtaatgtactaatatttgttgagccccaccatatgctagactctattgtcttacttatacctctcagcaaacctataagttaggtcctattagctgatttatagatggcaaaataggctcagtgaggtcaagtaacttgccctatgttatagagttatcagtgggaaagttgaaagtggtcaagggctatttatagtcaggagaaattaagcgagtttagagtcattccttttctgtagcattacattagtcctgaaataaagcaaaatgtatcaaattcatataccatatataaatatatattttattttattattattattttaagacagagtttcagtcttgttgcccaggctggagtgcaatggtatgatcttggctcactgcaacctccgcctcctgggttcaagtgattctcctgcctcagcttcccgagtagctgggattataggcatggaccaacacatccggctaattttgtatttttagtagagacatgttggtcaggctggtctcgagctcctgacctcagctgattcacctgcctcggcctcccaaagtactgggattacaggcatgagccactgcgcctggtcctgtattttagataagaaagatgctttatctgtctcccattggaatacacttttgttgttcgttttttttaacttaattaaacttgaaagccaacttttgtcaaaacagaagaaaataaagcaatttttaaaaaaatccagtatttaaaatacttgtcatttataatatatgcatataacagaaaagtagaaaataattttgcattttaaaagcttagcttctacatggcaagtgtgggacataaagttgatacttgaccattaactggatatattctagattttcacatttaatgataatggatgtgtgtgtctcatggtcaaactaaaatgatttattttttacaaattatctttatcattagcaaaccagtcttacttttattagtcaattataagtccacagagatataggagctcaatttgttacagggaacttaagcattccatggattatctgagctgaatttgaagaatgtactgtggagatcttctatgtgacatatataaaggacgtaggtcaactactggttattatttagaaaatactttagggaaaaaaattatcttctggggccaataattgagttctattaaactacagaggtagataattttgaaatgagaaatcaaaatatattttgattttatattactcatattttcattttattcataaagtcttttggaaaaagacaacagaaattgtactttgttgagaagactcctagagccaaatagtcacagactcagaatacacagagacaagcaaagatggttccagcaagctctaaggacacagacatgtgaaagaggtgctgaagacacacgaggactgatgcatggtagatgtcatcctgatatggctgggcttctggactcactgcctcctccttctagaacccagcacctccaaggctgggagaagagaagtttggggtctatgggaaatgacctctggaagtggctgtgactgtttccaaagacaaatacaatctagattctcgaaacaatgcaattgaataaaaaatgtaagtttagcagttagtgaaacattaagatgagatacaggagtaaacacatttttttccataaaagtagtggatgttaaataatgaaatacagtggtaaaacaattacagcctggaggctttaagatgtaaatcaaaaatggagaccagtggtgttaatatcatatgagaggattaaatatgagctgctggtccaactgtgttctgcaggaattcaggtagatggatgagagacaggctatgagtaaagcattaccacagctgggggtgcagtgtatggaagctcatcctagctaacacttggagaagaactcacacattgcaaacatatccagttaaaaactggcatttgctgcaactaaaaaaggcaagtgatggtctaggtgaactgccttttctttctctccttccaaaggacaaaattaatttttatttttttttgagacggagtcttgctctgtcacccagactggagtgtagtggtgtgatctcggctcactgcaagctctgcctcccaggttcacaccattctcctgcctcagcctcccaagtagctgggactacaggtgccccccaccacgcctggctaatttttagtattttttagtagagacggggtttcgccatgttagccaggatggtctcaatctcctgacttcgtgatgtgcccgccttggcctcccaaagtgctgggattacaggtgtgagccaccgcacccggccccacaaaattaaattcttaattaaggaaactgtttcttttacatctattttttcatcccaaactcaaatgccaaatatttagctattatacatgtattcatttgcttagaatacactctatccagcttgacatttcctttaaattttcccattacataattagattcttgatcctcatttatgtgatgtttccatcctgtgctgggttttatgctccaaatacatgtcctttcatactttaatggacacaaatgtgctttataaatattttgaaatccattttaaggtaatttattgagtgaaaattctgtgctcggtattttattggggtcagtggtggggtaggagaaggaaaggacatggcttttgccctctaaggaagttgcagggaaactgtctctgatttcattatcaaagcgaggcccctttctatttctccatttcaataccttttctactgacttcagatctatcagatgttataattatttcccacttgtgtttgtgtaactgtgttctgactatccacacattaggtgtgggctctgtgaaagcagggaccatattgatcctgttcagtgtcataccatatccctagcatagaactagtacaggcataacaaagatctgtgaaaaagtaaatgcatgcataactcagttgatcaattaatgtacatcacttggcagaagaataaaaggatcacgagagcagatgaaagaagactttatattttgcagaagaaaattttctgtgtcttcaaatgatcacaaatataattaataaagttgatgaggctttcttcaaaatggtgcttgtagaaaaagtgagagaaaggcaaaacaagagaaataatatggatatttagcattctggatgtttgctaagtgacaatttaatcacaagaatacacttcacaggccgggagcggtggctcacacctgtaatcccagcactttgggaagctgaggcaggcgatcacgaggtcaggagatcaagaccatcctggctaacatggtgaaaccccatctctactaaaaatacaaaaacaaaattagctgggcgtgatggtgggcgcctgtagtcccagctactcaggaggctgaggcaggagaatggcgtgaacctgggagcttgcagtgagctgagatcgcgccactgcactccagcctgggcgacagagcgagactctgtctcaaaaaaaaaaaaaaaaagagtacatttcactccattgtcgagagagagagatatatatataaaatacatattaaattatgtgtgtgtatatatatatcttttaagaccaattttattgagatataatttatagacagttaaagtcactcatgttgtgtataatacgattagaattttgacaaatgtgtacatacagttgtataattggtgccaccatcaagatataaaatatttccattacccataaaaagtttcctcagtcccttttgtggccaatgaatccccaccttcctgcaaccaatggttttctttcagagactatagttttttgttttcaaactttctgtgaatagaatattacactgtgtatttgataattgttttctttcaatcagcatggtgtttttaaattcatatatgttatgtatattactacttcatcctctatttttgcttagtagtattccttttctagctagaaagtagtatcaagatactaaaatatatttgttcatcacttgttgataggcaactataaataaatttattgccataagcatgtgtatacaagctttctgtgagcatatgttttcatttttcctgtataaatttctacaagtgagattttggggtcatatggtaaatgtaccaaagtattttccaaagtaatgtattattcttcattttcatcagcaatatgtgggagttctagttgttctacatctttaccaatatttggaatcatcaatcttcttaattttagtcattcttttttttttttttttttttgagatggagtctcgctttgtctcccaggctggagtgcaatggcacaatcttggcttattgcaacctctgcctctcaggttcaagtgattcttctgcctcagcctcccaagtagctgggattacaggtgcctgccaccacgcctggctaatttttgtatttttagtagagacagacagggtttcaccatattggccaggctggtcttgaactcctgacctcatgatccgccctccttggccttccaaagtgctgggattacaggcatgagccaccgcgcccggccttgatgacgtctctctttcacttttgttcctgacagtccagactgcacaatttcggatgtgggagactgggtgatttctttgatcttcccaaccaaatatgacttacttaaggattttacctgtaaaatacattattaaaggttaagagaagggtgacaatggtggtctccttagcttaactgaatggttatggtttttagttgtagttgcaatcttatgcttgtgtggttctttgattagtgtttgctttctctatcctatactattagcttcatgagaataggaaaattattcctctttgaactcaccattgtattcccaattctagcacagcgcctgggatttcctctgtatgtgtttttgaaatgcacccaatagatccacagacagattttaaaaatataaacatagaaacaaatccttctggtcttgaagcttgaaacttacatttgttttctctgagtttcttcctcaggaaatggactctcagctctctcaaaaagtatcaaagaagtgaaattcatcagaccactgtgtcgagacaatgagatgccagatgccagattccttatttgtcatgattgcttccttagccctccctagttcctgttttcctgctcatagttacatttcttccttgctatataatcccctaatttcggctggttgaggagatggaattgagactgatatcccatatccttagctgtagcatgcaattaaagccttcttccttggcaatattcattgtctcagtgattggctttctgtgtgcaagtaacagaacctagattgaactcctggtatttcagtaacattttgtgtgtaagaaagaggctggaggaaggagagtaggggaaataggaagagtgtcttaatatttttgttgctataacagaataccacagactgagtgatttataaagaaaataaatgtatttagctctgaggcctaggaatgccaagagcatgatgctggcctctggagaaggccttcttgctgcctaacaacatggcagggggcatcacatagtgagagagcaagagcaaaagggcttatgataaggaacccactactatgctagtgacattaatccattcatgagggcaggactgacataaatctattcatgagggaagagggattaagtttccaatctatgaacttttggaggatacattcaaaccatagcagaaagacagacagagatagatatggaaagagggaacaagcacacatcacacatacaaaaactggacaatatttttgtaaatgaaatgcctagagcctctctcgtatattgtatttgttgatattttctcaatttaaacttatcactccataatttctctttttcttccccaaaatgatgtacatgtttcttccttataaccataaaacacagtaattgtttcctggaaaattttaaatgtctcactacaattcaagtatcatacttactatatgttttttatcttctgtatattttgaaaatgtaagagcattattgtcttatacaaaataggtgctagcagagtgaagagacaaccaaaaataactcaataagaaatggacaaatgatccaaatagacatttttcaaaagaagacatacaggccaacaggcatataaaaaatgctcaatattactaatcattagagaaaggcaaattaaaaacactttgagatatcaccccatacgtgttaggatggttattataaaatgacaaaatataacaagtgttggagaagacttgaaggaaaggcatcatggaaaatagcatggaggttccttcaaaaattaaaaatgaactaccatatgaaccagcaatcccactactgggtatatatccaaaggaaatgaaatccgtatgtcgaagagatatctgcaacaccatatacattaaatcttatttatatattagcccaagatgtggaaacaatgtaagtgtccatcagtggatgaatgaattttaaaaagtagtatatatacacaatgaaatactattcagccataaaaaataatgaaatcttattatttgtgacaacgtggatgaacctggaggacattatgttaaatgaaacaagccaggcacagaaagaccatatgatttcacttttatgtcgaatctgaaaaagctaaactcatagaagtagagagtagactggtggttaccaggagctggacttggggtggggagtggggatgtttatcaaaggattcaaaatttcatttaggagaggggaaatattcaagaagagatctaccgcacaacatggtcactatagttaataacaacatattgtatttttgaaaaaaaatgcaaagaaacaaagtaagtattaaataaaaactggttctttgaagctttggcactgtaatatatgaaggccagaagccacatttatatagttccgtttcttgagcatccaagacaatggatgagatgacagtgttgaggaagacaggtcactcactgcgaacactagattcagcttctccccctgctgtttgactcattctgcagaaggtgagaatttatctgaaggagtttacatatttttatgtgacaatgtattcctgagaagataccaaattctttcttctacatcaaaaatacagcatgaaactgacaagagagcacataaatgatgatttttttttttttaagtttccaggaatatcacatgtatcatattactgaaaagaaaaagagcattttatgccatgaaaaactttggatatccttgaataatgttgactaaaaacagtgagtttatttagtattcattgtgtctatatttggagtgtatatttttagtatttgtcatcttgcttatcaaactcctgaatctcacttaaaaagtattttccaaagtttttgaaatttctccacaaaagaagaaaaaacaaaaaagcaagtattggaagtcaaataggtttgagaaatattatgacacatgtccttcttgcacatcataaagcctctaacacttttcatagtaaaccaataaatgaaactcagacttcttgctttgcttaatcaaaaaattaaagttttccaaacttctttgactacagaatcttttgacaacacaatattgatcattgcacactttgagagatattactctacaaaagtcactgcacagcaccactaaaatatggtgaccgataaaatgggcaaaggtcattcagtgaaagtttcaaagcaaagagaatgaatgaatatatatatatatatatggatgtctactttttggattacagttttcagattatgtttgttttaaataagccagtctgctttcataataattatacttttaagccattttctgatgagacatttgtcatcatgagaacaatgtagtaaaagtttgttacactggggattaagatattagagtttccattcaagattccctaatactggaagaggttcacttaaattccatgattctatgagaggagtcaaatctgaggtgcaggctctgcaccttcccaggcctgcaggggctttgcaccttcttgcggaacagttgccagctgttatcgcttcactcttaggtcactgccttcagtcaagtcttttttttttttttttttttagacagaatttcgctcttgttgtccaggcttgagtgcaatggtgcagtctcggctcactgcaaccttcgcttcccgggttcaagcaattctcccgtctcagccacctgagtagctgggattacaggcacccgccaccaagcccagctcattctttttgtatttttagtagagatggggtttcatcatgttggccaggctggtcttgaactcctgaccttgggttatgcacccaccttggcctcctaaagtgtagggattacaggcgtgagccaccatgcccggccccaagtcaagtctttttcacagccttggttcaccataaaactaaggtggacaattgtcatggacagaattgtgttgcctcaaatttatgttgaagtcctcacctctagtacctcagaatggggctgtatttggaaagaggacctataaagaggtaattgaggtaaaattaggttatatgggtgggccctaatcagtaagactgatttccttgtaagacaaggagatgtggacagagaccacacacagaccacaggacaatcatgtgaggacacagtaagaaggtggccattggcaagggaaaagagagaggcctcagaagagaccaaatgtgctgattccttgaccttggacttccagcctccaaaactgtgagaaaagaaattttttatggctgcatagtattccatggtgtatatgtgccacattttcttaaaaatgatgagttcatgtcctttgtagggacatggatgaaattggaaatcatcattctcagtaaactatcacaagaacaaaaaaccaaacaccgcatattctcactcataggtgggaattgaacaatgagaacacatggacacaggaaggggaacatcacactctggggactgttgtggggtggggggaggggggagggatagcattgggagatatacctaatgctagatgacgagttagtgggtgcagcataccagcatggcacaggtatacatatgtaactaacctgcacattgtgcacatgtaccctaaaacttaaagtataataataataaataaacaaagaaagaaagaaagaaaaaaagaaatttatgttacttaagccactcagtctgtggtattttgttatggcagccctagtaaactaatacaaatatttttagggacaacaaaccatggactttgttattctagtaagatgactttagcactattacctacttctaccttgaagtggtaaaaaaaggcagtgagaagcatttccatggagtgtataaatcgtgtcccgtgaaacagaattagctaataaggttaacacctgtcagctgtatatgatgctgcgtctccaatctccatccggacagcaaaggggaaggcatggacaggagacctgccttcagaagagcagctgacaaaggggcccacagcctggggacggtgacggcagtagccccccgaggcctgggatcccacagcacaattgtgaagggaaagtcttacttgctgggcccagatgtgtaattttctcccaccactgtttttttttgtgaaaaattcttaaataaacatggtgttggacatttttctgactaggaagttaggatatttgcttttctagcatctttattagatgactttttatgtttgcaaagtcactcagaaaaaacttcatcctcccaacacctccctggaccacagtccccacaaatgacattgaactcacaacataaaggaactcaccactaggtaaataggtgcttgactgtgatttaacacctgaattactaaaattgattgcaataattatccaaagaaaaacagccaagtgcagcagtaacgacagcctctgaactctctccacatcttcttgcagacagcgtctgagctgtttccatgtcttttccgggacagtctctgagtttctgagctctttccacgtcttctccgggacagcctctgaactctctccacgtcttctctgggacatcctctgagctctccacgtcttctctgggacagcctctgagctctttccacgtcttctctgggacagcctctgagctgtctccacgtctcctccaggacagcctctgagctccctccacatcttctctgggtctcctgtggagtctgatcacctttcagttaaggcatctcctgtgagcagcccagttggctactctgagttctgggggtagctgtccttggtttctctgaattgcccagaaaccaacctttctgttgcccatcgtagtgcctacgtggcttagctggagccctaccctgcttttgttgcccaacaaatgcctatgtgacagagctaaattcccattcagctttaactgcttagttttagaaaacaggatgtctggggtcagaagttccttcttaggactaaactggctgaagctggcaaaatccgcaatggcagcttgacctctgaaaaacctctagcttcattatgatccaatttccatgctaaatgacactcccactggcaccttgacagttgacaatcaccatgacaatggccagaagagaccaaaaacaggcagaaaagaggtggctctttgattccaaaaaaacctacctcccttcccaagaaaagctatgaatatttctccctttcctctgtatacccagccccttcattaagaatcctcagttctcaggctctgagaagttgatttgcaggctatgctcccacttctgcaattccatggccattgaaaaaagcccacactgtttgatactcactctcggtttggtgtattggcttcacaccaaacaagaaagagctcctttaggggtagtcaggaccctgattatattcccacatagaaactgttcccactcactactggcacagcagaacacataaactgtcagatggctccatttcaatgatttgacttgtaattctcaattgtttctgttcctaagattttaggactttctatcaactcataaaaaaaatctttaaaaaggtaaggcaaccttcaaatctaagatgctcagctttaaactagtaagttcttaaggatgttttttttccttcaaggaaactattctcctctttgctgagcaataatacaggttttaatattaaataagtacacaaagtaaaagaaacagacaaaaatgtcttcatagcaaggctgttaacagatttctttcttttttttttatttttgagatggggtctcactctgttgcccaggcgggagtgcagtggcacaatctcagctcactgcaacctctgcctcctcagttcaagtgattctcctgcctcagcctcccaagttgctgggatcacaggtgcctgccatcacgcccggctaatttttttgtatttttagtagagacggggttttgccatgttggccaggctggtctcaaactgctgacctcaggtgatccgcccaccttggcctcccaaagtgctgggattacaggcatgagccaccgtgcctggccagatttctaatatacgtaaagaaaaaagaaaaattttcaaatatttgtttagataagtactgatatttaaaaaaacaaccaagcctaaatccctagatttacaatttttaaaaaataagaaaagcaatgtaattcacagaataaaatcttttggagtaaagtaatataactctaacaaattggtaaatctaggcaagaaatgacttgcccaagtaacagacctagtaggtggagagttcatctgactccagaaaccacactctacaaaataaacttattgacgtgaagaatgtatataatctgtaactggtgtgaaactgtggcagaaatacaaagagccgtggtcttgctcatgatgttcaaaggcaatatttgaactgagggatggctgtgggaattgaagtggtcactggagaaacgtgtttgagattgtgaaccatggggaacagggggtggtaattctggattttcggcatagaggagaaagaaagaactgcaaacatcattacagtgaaggagggtgaggccctccgaaaactgattgcgtttcaccagaaacactgatccagtgggggcagctgaagcacgaaaatgattagaaccagagtgatgtcacccacttttctttctttctttctttttcttctttttttttgagacagagtctcgcagtctcgctctgtctcccaggctggagtgcagtggcgcgatctcggctcactgccagctccgcctcctggggtcacgtcattctcctgcctcaggctcccgagtagctgggaccacaggcgcccccaccatgtccggctaatttttttgtatttttagtagagagggggtttcaccgtgttagccaggatggtctcgatcccctgatctcgtgatctgcccgcctcgacctcccaaggtgctgagattacaggcgtgagccaccgtgcctggccgatgtcacccacgtttcttaggaaagacgttagcatcctctaaatcctcaccgactgtgcctggcgcagcattattttgcagttttctgggatttacagttggcatcatttgcacagcggcagcgtgacgtggctgtggagagcacggaagctctgtccccacggaagtgggctcttctggttgcaacatggtggaggccagcgcggcctcaggtgagggaagatgccacagcaaacctctgagcaaccaagatgacaagcacctgcttggaaaaggtgacaagccacaaggccataggcccagttataaggatgaattgtgttacacgaatggttataaacctgaccgacctcagaaggtatatggaggaggcaattatcaagccccttgatggtctgtggctggatgcaccatactttgccaacggtgtgagcatggcagagaatgtaggtgtgtatataggggaaaacctccagaaagttttttctgtgggagttctttgtaaaataataacaatgcaactggaattatattgcaatctataaagggaaatcactcttagggatcaacattgtagaaagacaacttgttttttgcttctttgctcagtgttaagaagtcatcacatcattgtcaccctccccacattctgttctgtagtgcccgatttgttgaaagcagtatgaggcctgttttaaacataaatctattctaaatctaaatttgtaatacattctgaatgtcatttagacagtcttttgcctggagattaaaaattactttatttctagcaaagtgctctgacgtaaaatattttaacaacaaagaagatctgtgtttgttgttttctccattatctaattattgatatccatttcatctgggcacatataaatggtaaaaatatttacaagctttgaattaggtgaatctaattaaaaataaaatatagatgttaatagagcctggaaatattgtcaatatctttttaatagattgagccccgttgattatttcttctggggtaaaggctcaaatttattctgtgaaattagacactcaaatcatctgaggcaatatatggcagatgaatatacactgattgatggaaatgttgctttaatgcacattgttcattgcaattttgcgtagattactgaactatgaattactattgaggaacagcacattcaacgtgtcatagcaatcaactatttagtatggacattttctatgtttctagattttctggccactctgagcaaatttaaatcaaatgactgaagtataatcacttattttaactctgttaaaacagtcaacttgaaaagtatatttttctgtatgaatttttttttctaattgactctattttgttctgatacctaaacttatttaagttgcgctgttgaaaaaaactataggccaagcgcggtggcccatgcctgtaatcccagcactttgggaggccgaggagggtggatcacgtggtcaagagatccagaccatccgggctaacacagtgaaaccctctctctactaaaaaaaaaaatacaaaaaaattagccagtcattggttgctggcgcctgtagtcccagctattcaggaggctgaggcaggagaacggtgtgaacccaggaggctgagcttgcagtgagccaagatcacgccactgcactccagcctgggtgacagagcaagactctgtctcaaaaaaaaaaaaaaaaaacaacaaaaacaaaactatatatatatgtatatgtataatctgaagatccatgtcgattccattattttacgatgcagtgacattataaggaagtggaaaaattaagttaaaattttttaattatgatgaatatagaaaggggatttcttgttgaaacaaataggctaaaagagccttgatgtcagctatgcctctcttagagaaaagactgtgaccctgtcatcccgttggataatctagtgatatgctttaacagctattgttaaaatagattttaccaaggcaaggacaacagtttgcttatgagcaatgagaagtaagtagtcttaccagagtgcaccctttggaaagtgctgcgtatataattagtgaggccattcataattcatttttattgtacaaatgctgattaaatgtataccttcttccactcaaatgttaacgtgtcccttcctcaatacattttattaggctatgtatatatctcaagcatagattaatttgttttgtaagatttcaaaacattccttttttagccctgtaatgaatataaaatggatccctactgcccatcttagagaatgcgtgtttcatagaactgtttaaaaaataaatccttttaaattgcccatctgcttaagctatgtttgtggaacattaggactaagtcatgtctgacaaacatgtgtcatactactatttgagggcattactgcattttaaggaataaaataatattattaagaagtataatttttccaagtgatacaataagaatattgctagagatttgacctatttgtgaaaaatctttgcatgattattagcttgctaaaaataaaatgaactctgcaaacgtgatccaagctgttctgtatgaaattatgtgctagttgcacagtcccctgggagaccagtgtgagtccagatgcctctttgctggtttgttttatttctggggttcattttctagaggtttttatcatattttcaaagtacagaagtcaggcatctcaaattcaagtcttgtctcccccaaactttaaaaaatatatgacattgatgtaatttggctggataataacaaactgaacaaataagatattttctttcattgaaggttggtaacattttcttcacttaaaaatttttggttgggcacagtggctcatgcctataatctcagcactttgggaggccgaggcgggtggatcacctgaggtcaggagttcgagtccagctggccaacatggtgaaaccctgtctctactaaaaatacaaaaattagccgagcatggtagtgcacacctataatcccagctactcaggaggctgaagcaggagaatctcttgaactccagaggcggaggttgcagtgagccaagattatcccactggactccagcctgggcgacagagcaagactccatctcaaaaaataatttaaaaaaatgaattttctaaattgtgggtcagaattcaagctaatggaaacctgtggaagaaagaattttgcaggtctgcctgtggaatccataattcttttcagaggcagcgctattacaaaaaaaaaaaaaaaaagtgtgaggatgtccccaagcagaaaaccgccttcactgcaatgctgacagtatctgggtgtcccagggttcctggggagtgcaactgatatcccggctgtgctgctactgtgctgagtggttttatatccactgagaaggatgtgtcaacaggtggctgctcaggcacctaaagaatggatggatgtgaggtctctgtgaagcctctgggccagatctctgaggagtatctgtgaggggcatctcacctatggtgaggacgctgtgtgagcgctgcatgggaggcctcagtgccaggctcctggtgagaactctgagtgaggtctctgtggagcacgcagaatgcgtgagttctgtgtggaaagtctctaagaaatccgagtcagtttctgtacgaggcctgtgaggccacatgaggtctctgtgggaggactccatggggcagcaagagggctccattgcctcttgtgaggcctctgtatgaggcctttgcagaaggtctgtgtgggaggtatcttccagaggtctctgtggggtctctgtgggaagtccctgtgtgaaatctccgtgctaggtctctgtgtgagggaccatggactatatgaagtccctgtgtgaggaccctgtgtgaggaccctgtgaaagccctacagaatctctgtgtggaatgtttgagggaattctatgtgagaggtttctgggcaatgagtgtggagcaacctgaggcctgtgtgaggaatctatacaaggtctctgtggagagtgggaggtctccaggcaaggtctctgtgtgaggaggactctgagagaggtctctgtgaggcagtggggggtgccgtgtgccatttctggggctggaggccggaggttgcagtgagctgcatgagtctctgcatgaggtccctgttttatgactctgtgtgaagtctctgaggtctttgtggggtctctgtgtgagatctccctgtgagaaccatggaaggtctctgacatttgcgggaggtctctgtgggactgagtgaagtctctcagcgtggcctctgtggggttctctgggtgaggactctgggaatctctgtgctaggtctctgtggggcaccatgaggactctgagagctccgtggggtctctgtggaggctgcagtgtgtctctctctgtggcagtgagaggtccccgtgtgctcactctgtacgagatatctctgtgaggttcctgtgggaggtctccgtgggtctctccattgctggcctcgctgcatgtcatgggagactgagctgcagaagggctaaggggttgttgtttcctgtgttcttgctggtctctcagcgttgcctgtggcgcttctcctggcctgagccatgggctccacgtccagctcctccacatcccagaactcgcgtcttggtttcctgagggaacccagcagcagccaggcatggcccatcctcagtggtcagggtcccagctctgtgccacactctcctgagctcccggaggaccggggctgctctctgctccaggtcccagctcctcctgctgatcctggctccgctgtcaccgctgggcccaccttggaggctgcttcagttatccgggccccagagaggacctggccccaggagaagccacaggctggggactgtgcccactgccccctgcaccccggtgccggccagtcccacatgttgggggcagggccatttccattgtcatctagatcagtggcactgcctggcactggcctctccaccattgaaatgaggcccctggaagtgggcctcttgcacgcctgtatgtggcacaaggcagagaaaactccctctagagacctggctcctcctgtccatgatttgtggagacctcctgctttcccatatggacagggcccagagaggaggaaagctgtgctgaaagcagagggagacagcagggatggctcctgtcctgcccataccctgcccattctggacaggtcacttccagctcccttgtatgttcaaatcctgcctgcctgcatcttcccttgctggtctctgggacaagcaaggatgtcaggagccaggggagatttgctgtgtgaccccagctcagctgctgggcccttgtaagtcgccacctttccccagggagcagtcctggggctacgtgtatattaaaggtcaccagacttcgactcatgcctggggttctctagtccttgcttttccgcctattgtcaacacatcctttaaaaaattcaataggtaggccaggcgccatggctcatgcctgtaatcctagctctttgggaggctgaggccagtagatcacctgaggcaaggagttcgaggccagcctggccaacatagcaaaaccccgtctctactaaaaatataaaaattagtcgggcatggtggtgggtgcctatcatctcagccacttgggaggctgaggcagaagaatcgcttgaacccaggggccggagtttgcagtgagccaagattgcactacttccctccagcctgggcaaaacagtgaaactctgtctcaaaaaaaaaaaaagttcaatagattattatgtgcaagcttatcgaagatgttaagaaattcatcttccttattcactttgccttctcactaatatggccctctgtgttgggggtaaatgtggtttttctaggggtctgtgatctgggagctggagcagagacagaccctggggtgtggccaggatgagacactaggcccctctaggcctgtctaaggggttggaatgtcagagtctcctggctcacggcaccactgatggctccctcacacacgccactttgccaccttttcaattctctgtctgcatcccctgtagctctacagagtcccaccatcagaagcctctgcacacacaggcataccctactccattcacccagaactacttcactgaagctgagagacatgtaggtgagatagacaaaggccggtgacccaggagcagggtcattcactcatctggggcaggggagttcacggccctcagcaacctccatgaaggctgcccccctgaccccctagcccccacctacacatgcacagagctggaaggtctgtccccactgccactccagagtgcgagaaagggagaggcagtgggatggggactctctgctttgcatgttggctgagctaagagagcccatctccatcccagcctttgtcagggagagaaggggcttcccaggggcagacgttatctattctccaccaggatacccagggtcaagacttctcccacttctaaactcagggcccagcactctcccacccaaacttccactattttgtgacacatgaaggtactcggctgtggcacttcctggagcctgcatggagatgttcagtcccgtgacatctctgcaaaccttctccctacagctgcatgaagtttgaggtagagtaagtagtggaaagatgggttgaaccttatttcagagtgggaccttcataggtttttctcatcttgtttttagaattttttgttgtttgtgtaaagacggtattacggaaacataaggttcagtgaaggaactcaggatgaaggtgggcttacagcaccactgtcaacatccctccatgtcctgtcgcttctggaaaccaagcccacaccaagcatggcacaaataaaagccatcaccctcttatgaataaaaaaccatatatattgtggaatattaaatgttctgcatgtactaacatgagagaaaatattttttctctacatagagtgaattttttcttggggacttgtttttctccagggaaggctaaaaaagaatttgtgactgaccaaatcagataccttcccaaagaagacagtgccttggacagtggtgatggtggctagaggcaccggatgtcttcggccagtgctgagggggactgactggggatacagctttcttggggtgcaagatttggggatgtcgcaggccccattgctcattgttgcaccgcacacttttcaagggctgttgatttctgatttgtctgtctctgttgggacaaccctggctcttgagagtggcttgttgactgctggctgcatagctcagtattctgccgtgttctgagtagaagaggtgcctgtggttgcagggaaacccacagactggggcttgaaacttctgtttgtgctgatttaccttcgaggcatggcgcgcatggcaaagtgacattttcttgtccagcatttgtccaactgccgtcatgagaccctgagcttcagcactgctgctgtacacacgtgatctgttttttactgttttttggctctcagcagtgactggtgctggcttgctttttttctttgaaaaaatccactgaaaaatttgcttgatgttttctccaaaggggcttactgaaggaggctgtttctttgatggcagtagctggacgccttcatcctgatgggtgtcttctgttttcctgactggggtaagttgaggagtcctcaatccttcaagcctttcttcatgtttttctaagttgggtttcctagacttctcactcttgtgaatagggggaaacattggcctttggctcttgcatgagccttgacagtttgggtttctgggctcctcgtgcaccagtttgctccttctggctgccatgaggtcatgtagctcctgggaagcccgcatgttcccagtaggcatgctctggagatggccctggggcacttgagaaaccaaattctctgaagcgtggggcacaacagatgcttgcccatctggaaggagcacaacagcagcacaaacttgaggctgggtctctgactttgtggccattccaggctcaaattcattaacaacctcctccataagacacagctttcttggatcttgggagacagacactctagggtgtagagagcttttgctggtccctggagcctcgaaaccatgcacatcctcacttgtggcttggaggtttgccagcatacaggtttccaaggggactctgcattgtggcactgcctcccttgtctctccagcctttgaagattgggctcctaagctcctgctctgctggatgctgcctgtgaggctgtacgtgaggggcttagatggccacctgccctcctgtccagctggaggaggcttcaagggttcatgatcattccaagatgggattcctcgcggtgccctctggaactgcttccatgcaggtgaggaggccagaagactctctggcatgtgatcagatgctttggtcaacacctgctttctcagacttgccattggtggctttctaaggaacatgtccacctcaacttctgagccagccccagattcacaggtggctgaggagggaccagcaagctgtgtaagggacaaggatgaaaccttttccagtttaaagcactgaatgggcttgaggaccctgaggggtagaccccacctgtgtttggcccaaaacctcacaatatgggctcccaacccctgctgagtacacggctcgaggaaggaaagcacctgggctgtgttcacacaggctttcccacttttcggggctgctagattgctggttttcacatgggtgttggacacgggaagagcctggttgacagcaagccaggatcgacgcacacgcacggggatcaagccctcgttggtctggcccaagttcctgcccatgtgggctttcaggatgttttctatatgagtcctctctgtgcatcttaataaatcacttcccgagtcactcctcaagggcttcctcaagttcctttccaactcctcagaagtcacccccagaaccttccgtgggaagcttttcatatccctggatagattttgtggggtctcacccagaatttgccccagatgtgggcacgggtccctctctagctggaacttcaccttctgtgcctccttgctgctttcacctgtggacatggaggactgccagggactgggtttgcccttggcctgacttgtccctggtgattcgtcccgaagctgcatcagatccagagactcttggatccttcccaggttgccccagtgttggatgatccacttttttatgtgttgctccagttgtctccggagttcaggactgactggaaagttctcaggcagaatggatgtcaaactttcctggggaaggttaggagtggagacactaaagacgtcctgagatttttggaccctagagggtaaagccaacctaccttctagttgtctcctcaacaaaggccattcagggtgctgagtttcaggtagggagagagcttgcactttattctgcgatgcagggcaagctactccagtgttctgaatcagggatggaaaagcaggagataggactgggaaagaagattgaagatgggcctgagcctcggcctgagccataggtgtgggccggaattggggtgtggatgaaataaagggttggcactcgggccccagatgggacaggggctgggcctggaaaagcagtggggacattgtagtctccctttgaattgggcagacattggacatttcattgaacaagaaaggaggagactgtaaagtataagacctgtcagttacccaggcgttagccaccagggactcgctgtgcagagaggggaggccccagaaaagctggctataattcttccaaaaactttcctgccagagcctaggatctgagagcttctgaggtccgggcagctgtttcgagttctctcccatgttccagaagggttttgggtttgtggtgtcctgctcagcatccaatgatttagccaaattccgcaaagaatttaagtgcttttctggggtcattcgatttgtaaatgatccaacattttctttttcttcccaaatgttgaccttggctgtttctgtgacttgtatccccacgacattctggccatcagagctgagcaaaaacaggctaccagcttccatctgacaggtctctggtgggtggcgggaaagatgatcttgctggactgatgagttaaaggcgcacgaggttctggcagtctcctgccaccgggaggaggcagaaacatgactgtttgagccaccaaggcctgagatggctgggacagaagccaccaaatcctcatgtggagacaagctttgagggacggtgcccagtggaaatgccactgagtcacagtgagatggagttatcagtgtggagtcccgcaggggaggagcagtgaagccttttggaggaggcagagagcaggccagaggatcaggggtgtgtggtgggtgagggaaaagtgcaggtggctcgggtgaggggtgttctaggggaagggaaggttctggtggctgggaggcacttagggaggagactgaggtggtcattgggcctggtgatggggtggaggccagatcctgaggatgcttggcttgaggatccggggaagctaacggggagagaatgggagcagcatcttccataggctcatgagaggactgggaggctccatcaggtgctctttcacccacctcacctggggggtctggaccggagagctgaccaaagtcacctttgtcaaggtgtggccccaggaggctgcaggagacaggaggcacgagctgcagccaggagccggtggggccggagggcagagtgggtgctcgggccacagcccctccaccaccccacaccctgattgcccaattctcctgctacccctcgccccagggttttactcccatcctctgtccccctggtctccccatcccaggtcagctccaggctgcctgtggccctggggtcacgtcccagccctggtaggaaggatgcagggaaggggaagtgcctcacctctgcagttgtgaaagcaggtccgaagtctcctccaggcctctccggcactctctaccagctggaaatcaggagactgggttagggcagtgagggaggggcctgggttctcacaggaggctgagtggctgtttctttagggaggaccatggggaattagaccctggaccccacccatctgtgtccaaagccacatgaccccgacgttaatagcaaggcatggaggacaaggctttttcattcacaaagggcttccacacacggaccccccacccccacagtcctcacaactgccctgtggggagaaaggactgaggtggtctcaaagaggaatcagccttagcagagttggacagctgttcccagggagcgggaggccccctcacccccctccgcatccaggcaggcattggtctccccaggacacacacactgccccctgctgggtaacgcccagtccctggcccaccatggcttcattcccgcatggaatctgagaaggacccggggttctgatttccttcctaggagcccccacctcaggcttcttcaactgacttcttcagagtcagttcccttcgggacagatgagatcaaattaaccctagtgtgctctggcagagccttacctctcagactgtggtttttcatcctgcctctgggcctccgcctccgccctactggacactgggagacacgatgacgtacggagacaagatgacgcggagagacaagatgacaatgggagacaagaaagggtgagaagctaggaccggctctccctctctgccccagcccagccgcagcatgctgcactcaggaaccgcatggctctctctgtcttgctcagggagctctgtgtgcttcctcccactcttgtttaaatggatgataaactgcttttcttcttagaaaaacagcaagagggggctgggcgtggtagctcacgcctataatccaagcactttgggaggccaaggtgggttgatcacctgaggtcaggagtttgagaccagcctggccatggtgaaaccccgtgtctactaaaaatacaaaaattaggcaggcatggtggtgggcgcctgtaatccccagctattcaggactctaagacaggagaatcgcttgaactcaggaagcagaggttgcagtgagccgatatcactccatttcactgcaacctgcaccacagagcgagactccatctcaaaaaataaaataaaataaaataaaataaaataaaataaaataaaataaaataaaaataacacacacaaataaaataaaaatacacacacacacacacacacacacacacacacacacacacacagagggattttcaatatgaggtccaccacggacaccttcagtccctgttcctctgctccaggaacacccaagttcaggcccgcaggcactgctgagctatcaggtaggattctgcttcccagaagaccagaggagacaccaggccctggtgggaggccctcaggggcccagcacaggccccagatcaccccacacaggggaggctgggccctgagccacctgcaccagaaaggggctgatgagccagggctcagggcctggtctcggacagagacctccccagtctcatgactggtactggtgctgagtccactggtttgattttgccttgatgcctcctgtgctcccccacagatggactgagagcttgggatggaaatcccagtacactatctacccctaccaacccctggctgccctgcctctccctggaaggatgatgttctggtctcttctgagacttcccatcatagaaggctctccactggatttggaaaagtggaactaataataaaaagaaaggagagaatcaagctctgtgggttgggactgagggttccttacctttctcttcccaggcgatggtgagggtgggtcatcacaacggaagtaagataagtaggggagtaatacgaagaagaaccccagggcaaacaccaaagtgaggaagatatccaacacccatggtgtggaactgggggcgtttagcgatgaggcactaagtaattttaaaggaaagggaagattctccatgtgaataggcgcgttgctttcaagcaactgagctctgggcatccccgtggagactagggactggggcccaggcctgcgtcacagaggtggggccttgatgtcacaaagggctcctttgttggggaggggcagtgggagggggaggcgcagagggagggggaggtgcagcaggagggggagagggagggagaggggcaggggagggggagactgaagcacagcccctccccaccccccaagctggggatccctccaccatcccaccttctagatccctccttcccactaagttttgtcagtgatagccaattttctattctttctccctggaatatagatattacctggttccttttatctgttggagacggtggcttgaggttacctattttatagcccttgaaaatctgaagttctgaaattttggctatgtaccagggatttttattctcagaatctcgttcatcctcaactccagcttttccacactatgtttttgtcttgtatcaatccagggacaaaatgtaaatttcttttactcttatttagttttgcaaattttgaatagtaagttttaaaaaattatttctatctcactttcaatcaaagggaactacccacatacaattaagatttttttttttgtcttttaaaattttatttgtgtacttatgtatttattttattttaactttcgggatacatgtgcaggacatgcagttttcttacataggcaaatatgtaccatggtgatttgctgcacctatcaacccatcacttaggtattaaacccagcatgcattagctatttttcctgatgctctccctaccaccggccctccctcgacaggtgccagggtgtgttgtttccctcccagtgtccatatgttctcattgttcagctcccacttgtaagtgagaacatgtggtatttggttttctgttcctgtgttagtttgctgaggataatggcttccagcttcatccatgtccccgcaaaggacttgatctcattcctttttatggctgcatagtattccatggtgtatatgtaccacattttatttatctagtctatcattggtgggcattgggttgattccatgtctttgctattgggaacagtgctgcaataaacatacacgtgcatgtatctttgtaatagaatgatttatattcctttggatatgcaataatggtatatctgctacagcctctgtactgcactgtggggaattctgcccagcgcaaaccacccagtctccctagcactggtgggggaaaaccaccggctagacccgcagtaatggcggtcacccttccccccaggaacttggtcttcttaggcagactccaggtgctgtgctagccagtggggattccatgccagtgggtcttagcttgtggggttctgtgggagtgggtctgcttggctccctggcttcagccctcttctcatgggagttgatggatctcctgcttcactggatttctgcgagccaccagagtacgcagaaactcctacagctcagtacctgcccaagtggctgccagctggagcccctgctatgggtctgcacagctttgtgcttgggacccaaggccctggtggtgtggactcacaaagggattacctgttctggggtttgcaaaaatctgtgggtaaagcacagttctccgggtgggtagcacaatccctcactgcctcccttggctggaggagggaggtctctttgccctgtgtagctcttgggtgaactgtcgcccaactctgcttttccttgctctccatgggtcacaccaactgcctagtcagtcccaatgagggaatctggatacctcagttagaaatgcagaattcactcgctgtttatgtttgtctcagtgggggctgtagagtagagctgtttctactcaaccatcttggcccctccccccaattaaaataattaatattcaaaatttgtaattctaattatgaaacagttataagtagttaaaccttcaagtggtatttctgtaaatgtgtagcatttacagttctggacttggtaatgcttaaagtgcacgataacttatgggactgctacataggcatacctcagagatactgtgggtttggtttcaggccactgtggagatgagctctttagggcagtgcccaatggaagtgccattgagtcacattgagacggagtcagaatgcagtccagcagtgggggagcaatgaaggcttttggaggaggtggagggcaggccagacaatgggggtgggtatgatgggtgaggggaaaatgcaggtggcttgggtgaagggcgttctaggggaagggaagattctggtggccagttctgcaataaaacaaatatggcaataaggcaaatcacacagaatttttggtttctcagtgcatataaaagttaggtctatactatactgtagtctattaagtgggcaataccattatgtataaaaaagtcaatgtacataccttagtcaaaaattattttactgtttaaaaatgctatcgatcacctgagtcttcaacatcatgatctttttgctggtcagtggccttgcctcagtgttgtggctgctgactcatcatggtggaagctgctggaggtgaggtggctgtggcaatttcttaaaataagacaacaatgaagtttgctacatcagttgactatttctttcaagattcctctgtagcatgcaatgctgtttgacagcattttacccacagtagagcttccttcaaatcggagacaatcctctcaaaccctgccactgctttatccactaagtttatgcaattttctaaatactctgttgtcatttcaacaaggttcacagcatctacacctggagtagtttccatctcaagaaaccactttctttgctcatccaagttctcatttgttaaaattttgtcatgagatttcagcaattcagccacatcttaagttctcttcacatcttttaatcttagttctcttgccatttccaccacgtctgcagttacttcttgcactgaagtcttgaaccctcaaagtcatccatgaggattggaatcaacttcttccaaatttcttttaatattgatattttaacctcctcccatgaatcacaaatgttcttaattttaacctcctcccatgaattgcaaatgcttctagaatggtgaaacctttctagaaggttttcaacttactttgcccagatctatcgaaggaactactatacatggtggctacagccttatgaaatgtatttctcagataatcagccttgaaagtctaaattactcattgatccctgggctgcagaatggatgttgtattagcaggcatgcaaacagctttaattttcttgtagttctccatcagagctcttgggtgaccaggtaaattgtcaatgaacaataatattttgaaagagatctttttttaaagcagtagttctcaggtgtgagcttaaaatattcatgtcgtaacagatgtgatgtcattcaggctttgtcccatttatagagcacaggcagagtagatgtagcatagttcttaagggccctagaattttcagaatggtagatgagctttggcttcagcttaagcccctaacaaaagagtcatcctgttctttgaagcattgaagtcaggcatttattttgctacctggctgtaaaagtcctggatgacatcctcttccaatataaggctgttttatctgcaataaaaacctttgtttagtgtagccacctttgttgcttctcttagctgatcttatggatgacttgctgcagcttctacatcagcacttgctgcttttccttgcacttttatcttatggagaagacttctttccttaaacctcatgaaccaatctctgctagcttcaaactttttttctgtggcttcccaacctctctcagccttcagagaattaagaagaattaggtccttgctctcgattagggtttggcttaaggaaatgttgtggttggtttgatcttctatccaaaccactcaaaccttctccatatcagcgataagtctctttcactttcataccactcatgtgttcattggagtaatacttttaatttccttcaagaactttttcttttcatgcacagtttggctgttaggtgcaggatgcctagtttttggcctgtttcagcttttaacatgccttcctcactcaccttaatcatttctcacttttgatttaaataagagatgtgtgactcttactttcacttgaacacatagaggcctttgtagagttattaattggcctaatttcaatattcctgtgtctcagaaaacagggagacctgaggagttggggggatggaggaagggcagatcgatggaaccattcagacacacatatgtatcaattaggctcattgtcttttggagcatggtttgtgatgccccaaaacaatgacaatagtaatatcaatgatcactgatcacacattaccgtaacagatataataataacaaaacatttgaaatattgcaagaattacaaaaatgtaacacagagatacaaaataagcacatgctaccagaaaagtggcactggtagacttgcttgatgcagggttgccataaaccttcaacctgtaaaaaatgcaatatccaagaagcataataaagtgaagtgcaataaaacaaggtaagcttgtatatgtatgcatgcacacaccagtacgcatccacctatccacacacaaatctttgtacaaacaaatcctgtattttcaattccaacaatacatcatttgcaccttaaaaatatctgtcaaccttgtagtatcttttctgtctttgttatcagggtaatgctggcctcataaaaaatgtttgtattccctcctcttcaacttttggaagagtttgtgaagaaatggtactaattcttctttaaacatttgctagacttctccactaagctatctggtcttggattttcctttttcaggagctttttgaccactgactcaatatttttactcattatttgtgttgattttctatttcttcatgtttcaatcttaggggatgtatgtttctagaaatttctctatttcttctaagttaaacaatttgttgacacatagttgtttagactgttattatcctttgtatttctatggtaccaattttaatatctgcttttttgttctaattttatttatttgaggcttctctcttttttcttagcctagtgaaaggttggtcaatttttattatttttattttattttattttatttttttgagactcagtctggctctgtctcccaggctgtagtgcagtggcgcaatctccgctcactgcaagctctgcctcctgggttcatgccattcccctgcctcagcctcccaagtagctgggactacaggcgcacgctgccccgctctgctaattttttgtatatttagtagaggcggggtttcaccatgttagccaggatggtcttgatctctgacctcgtgatctgcccgcctcccaaagtgctgggattacaggcatgagccaccgcacccagccattatgttttcaaaaaatcagctttttgtttcattgatcttttctattgtttttctagtgtatttcatttacttctgctatcatctttgttatttccttccttcttctaattttgggcttcattttttttcttttctatttctttgaggtttattgtttatttgagatcttttttcttcatttagcacttaacctgtataaacttccctgttagaattgcttttgcttcatctcataagttttagtatgttgtgctttcattttagtttgtctcaagatattttatttcttttttgatgttttctttgatctattggttgctcaggagtgtgttggttgatttccacatatttgtcacttttctaagttttctcctgtttttaattttcagtttcatgccactgtggtcaaaaagaatacttgataagatttcaatcttcttaaatttgctaagacttgttttctggcccaatatatgacctgtgtaggagaatgtactgtgtatgctcaagaagaatgtgtattttgctgttttggaaagtaatgtcccgtatatgtctggtccatttgatctatagtgtagttcaagtcatctgtttccttattgattatctgtctgagtgatcaatccattgttgaaagtgggatatggaagtccccaactgttattgtattattgttgtcacttctctcttcagatttgttaatatttgctttatacaattaggtgttccaatgttgggagaatatatatttgtagtaattatatcctcttgatgaattgacccttgtatcattctataatgactttctttccctcttgttacagtttttgacttaaagtctattttgtttgttgtaagaatagctactctttcttttttttgttccctgtctttcctttcagtctatgtgtgtctctaaaggtgaagtgaatctcttataggcggcatatatttggttattgttttactgtccattcagccactctgtgtcttttctaatttggtccactgatatttaaagtaactattgataggcattttgcagtttctttgttcttttatttctctcttgctgtgcatgatttgattattttgattattttctgtagtggtatactttgattcttttctgtgtctttgtattaattcttttttaaacgtggtaaaattttcatttgtgtaactattacatgttttgtctttgtgattatcctgaggcttccataaaacttcatatgctctcatgtgccacataaggatgttttggtcaatgatgggccacatatacaacggtggccctgtaaggttataacatttttattgtatcttttatatgtttagatacatttggatacacaaatgcttatcattgtattataattgcctatagcattcagtatagtacaatgctgtacagatttgtagcctggaagcaataggttataccatatagcctgggtgtgtagtaggtggtattatctaatttcgtgtaagtatactctatgatattcacaccatgacaaaattgcataatgaggcattattcagaacatatccacattaagaaatgtatgattatagttataatggtctattttaagttgataacaacttaacttcaagcatatacaaaaccctacactttactcccctccactttttatgtttttttgatgtcagcttttatttctttgtttattttgtagttatatttatttgtaatatttttttgtcttttaaccttttaaaatttaaagtgattatactccatcattacagtattaggaatattttgaatttgactgtatagttacttttactggtgactttttataactacatatgttttcgtgatgctaattagtcttattgcatttcagtttgaagaactccctttagaatttcttataaagcaggtctagtgacaatggactcccttagattattttggggggtttctgaaaaagtctgtaagtcctagccagagcaattaggtaagaaaaagaaataaaaggcatccaaactggaaaagaagtgaaagtgtctctatttgaagatgacatgatctcatatagagaaaattctaaaggctccaattaaaaactgttaaaattaagaaacaagcaaatttgcagaacacataattaacattaaaaaaaacctgttacgtttttatatactaatagttgagtatcccagaaagaaattaacaaaacaatctcgggccgggcacagtggctcacgcctgtaatcccagcactttgggagtctgaggtgggcagatcacaaggtcaagagatcgagaccatcttggctaacatggagaaaccctgtctctactaaaaatacaaaaaattagctgggcgtggtggcaggaggctgaggcaggagattggtgtgaacccgggagtcagagcttgcagtgagccaagatcacaccactgcactccagcctgggcgacagagtgagagtccatctgaaagaacacaatctcatttacaatagcatcaaaaaattaactacttaggaagaaatttaaataagacagtaaaatttgtatataccaaaaactataaaacactgatgaaagaatttgaagaagatacatatccctattactcagcgcgatctatagatataaagcaaccctatcaaaatttcaatggcatttttcaaagaaatggaaaaaagcagttctaaaatttttatgcaacctcaaatgaccccaaacagtcaaaacatccttcagcagaaaaaacaaaagtggaagcatcacattaccttattccaaactaaattataaagctgtagtaatcaaaatagtatgctactagcataaaaacagacatgtaggccaagggaacagaatagagagcatagaaagaaataaatccatgactttacaatcaattgatctctagcattggtgccaagagtacacaatgataaaatttagtctctttattaaatggtgttgggaaaactggatatccacatgcagaagaatgaaactgaacccttatctcactgtacatacaaaaattgtctcaaaatggatgaaagacctcaacaaaggactaatattgtaagactcttagatataaatatcggagaaaagctccttgatactggtattggtaatacattttcagatttgataccaaaagtatagacaacaaaagcaaaactagacaaatgggagtaaatcaaactaaaagcttcagcgcagcaaaggagacaaccaatacaatgaaaagataacctaaagaatgggagaaaatatttacacactatacatctgataagaagttaatatccaaataaattaggaactcagacaattccaaaggatcttgtattggtctgttttcatgatgctgataaagacataccagagactgggtaatttataaagaaaaaggtttggccagacacggtggctcacgcctgtaatcccagcactttgggaggccgaggcaggcagatcatgaggtcaggagattgagatcatcctggctaacatggtgaaatcctgtctctattaaaaatacaaaaaattagccaggtgtggtggtgggtgcctgtagtcccagtgacttgggaggctgaggcagaagaatggcgtgaaccttggaggtggagcttgcaatgagcagagatcacaccactgcactccagcctgggtgacagagccagactccatctccaaaaaaaagaggtttaatggattcacagttccacgtagctggggaggcctcacaatcacagtggaaggtgaaaggcatgtcttacatgacagccagcaagacaggatgaaagccaagcaaaaggggaaacccgttataaagcaatcagatctcatgagacttatttactaccatgggaacagtatgggagaaactgcccccatgattcaattgtcttccaccaggtccctcccacaacatgtgggaattatgggaactacaattcaagaggagattggagtagggacacagctgaatcatatcattctgccccagctcctcccaaatttcatatcttcacatttgaaaacaaattatgccttcccaacagtccctcaacatcttaactaatttcaatattaactcaaaagtccacagtccaaagtcttatctgagacaaggcaagtcccttcgagctatgaactcataaagttaaaagcaagttagttactttccaaatacaatggaggtacagggagcaggtaaacatacctgttccaaatgggtgaatttggccaaaacaaagaggctacaggccccaagtccaaaatccagcaggcctgtcaaatcttaaagctccaaagtgaactcctttgactccatgtctcacatccaggtcacacttatgcaagaggtgggctcccatggccttgggcagctccacccctgtggctttgcaggaaatagcccccctcttggttgctttcatggactggcattgtctgtagccttcctgtgtgcatgatcaagcttttggtggctgtaccattctggggtccggaggacagtggtcttcttctcacagctccagtaggcagtacctcagtggggactctgtgtgggggcttcaaccccatatttcccttctgcactgtcctagcagaggttttccattagggcaccacccttgcagcaaaattctttctggacatctaggagtttccatacatcctctgaaatctaggcagagattcccaaacctcaattcttgacttctgtgcacccacaggcgcaacaccatgtgaaactgccaaggtttggggcttgcaccacctgaatccacagtccaagctgtaccttggacccttttagccatggctagagtagctgggatgcagggcatcaagtcactaggtggcaaacagcagggggcccctgaatccagcccaggaaaccattttttccttttaggcctcttggcctgtaatgggagggactgctgcaaaggtctctgacatgtcctggagatattttccccattgtcttggtgatgaacatttgggtccttgttgcttatgcaaatttctgcagctggcttgaatttctcctcagaaaattggtttttcttttctatcacatcgtttggctgcaaattttccaaagttttatgctgtttccttttaaaactgaatgcttttaacagcacccaagtcacctcttgagtgctttgctgcttagaaacttattctgccagctaccctaaatcatctccctcaagttcaaagttccacacatctccagggcaggggcaaaatgctgccagtctctttgctaaagcatagcaagattttccttgactccagttcccaacaagttcctcatcactatctgagacaacctcagcctgaatttcattgtccatatcattattagcattttggtcaaagctagtcaacaaatctctagggagttccaaactttttcacatttttctgtctttttctgagccctccaaactgttccaacccctgcctgttacccagttccgaagttggttccacatttttggataactttacagcagcaccccactctaccagtaccaatttactgtattcatctgtttgcatgctgctgataaaggcataccaaagactgtgtgatttataaagaaaaagaggtttaatggactcacagctccatgaggctggggaggccttacttatggtgggaggctaaaggcacatattacacagcagcaggcaagacagaatgaaagccaagtgaaaaaggaaatcccttataaaacaatcggatcttgtgaggcttatttactaccacaaaaacagtatggggaaaaccgctcccatgattcaactatctcctactgggtccctcccataacacatgggaattatgggagctacaattcaacatgcgatttgggtggggacgcagccaaagcatatcagacctgaagagatacatttctaaaggacatacgattgacaataggtatatattaagaaaaagatgtttgccatcactaatcatcaggaaaatgcacaatgagatatcacctcacatctattaggatggcttttataacagtaaaaaggtaacaaatgttgctgaggatattgagaaacagaaacccttgtgcttagttgatagttgatgggaatgtaaattggtacagccattacagacaacagtatggagtttcctgaaaaaattaaaaatggaactcccatataatccagcaatctcacatctgggtatatatccaaagtaaagaaaatcactatctcagagagatatatatacttacatgtttattacagtgttatttacacagccaaggtatggaaactacctgtgtccattgacagatgaatggatgttttaaatgtattacacacacacacacacacagacacacacacatatgtaatggaatatcatttagcctttagaaatgaggaaatactgccatttgtaacgagatggataaacctggagtttattatggtaagtaaaataagccaggaacagatgcaaaaaaatcctgcatgatttcacttatatgcatactaagaaaatgtcaaactcatggtaacagagtaaaatagtgcttactagggcctgggagttgggggaaaagaaaaaatgtttgtcagaaagtacaaactttcagttataagatgaataagttctgcagatctaatgtacagcatagtgactaaagtcaataataatgtatacttgaaatttgctgaaagagtagatctcaagtgttctccaccacacaaacacaaataaaaaggtaaccaggtgaggtgatgaatatgttagcttgattgtggtaatcatcacttcacaatgtatatgtatatcaaaatatcacactgcataccttaactatatacaatttttctttgttaatcaataaaactggcaaaaatatcttttacatgttgccttgactccatttcttattttgtcaaaatagatagtcctcactgtttgcataagtttagaaacttgtgctacatccagaagtcaggagtgcggtagggtgaactaagttactgattctttaggaaccttagggtgtgaggtgggactggagttcaaggtctaggagctcagtctggtcttgagcagcttcttttttattttgttttgttttgctttgagactgggtctcacattctttcccaggctggagtgcagtggcaaaatctgggctctctgtaacctccgtctcccgggctcaagcaatcctctcacctcagcctcccatgtaacgggaaccacaggcatgtgccactatggctagcgaatttttttgtatttttggtagagatggggtttcccttgctgcccaggctggtcctgaactcctgagctcaggtgatccacccaccttggcctcccatagtgctgggattacaggtatgagccaccatgcctggccatgagcagcctcttctgatatccctagtgtgttctgtacacattttctttgtctgaatgcgcctttcctttctctctattggtctacagattttttccttctttaggatattattaacttgaattcaaatttttatcaaaaattggacctagctctttttattcatattttcctgctatattttttacactaatttattttcgataggttttattgagtgtttttttgacacttaaaaattttacctcacaatcttaacctttgatttatgtaattattgttccattatgagttatttctgtcatctcattttatgatttttcatactttctttactgtttattttttcctattgtacctttcactctatagatcaaatctttttctatttgtttgaaatctggaaatttttaacattgtaatggtggttatatcattatttatgttaattttctcaatttctgatatgtgtcaaaattaatatcatctcagcaaacaagataagtgctctagcctcctcttgccacctctggtttgctttctgtgttacgacagcactttgtctaagggggtgctttctgaagtttacttggggttgttttcaatatgttatgttttcatttattttttagagtatgataaacaccactaccattgattctggaaccctcaattctaacaccacggtgtatttctcttcttagtggagtatgacctctaagcattttcaaagggatttatttgaaataaaacttttgaggccttactttttaatgtctttttctgggctttcatatttaaaagattgtggctgcaaataattcaaggattaaaattggtttccttttaatccttgaaaaatattacttcattttattcttgtctccagcattgctgttggaaaggctgacaccaatcaaaaccaatttttccctaaaggatgatctgtcttctcatcattttgacaggatgtaacaaaacaaaggagtcttcaatgttctgagtataaatcattttgcaattataaacaacttaatattaatgcaatacaaaaagaattaaaaccttcttgagacatgcaagtgcacaggaaaattaagtatcatgcactcattcaggaagaaaaggtgcaaaagaaatttaatgaaagagatggtcgttagatgcaagtgtggctgaatgtagggatgcgatgctgacacgtggcagcaggcctggcaagctgtctatcccaattcaactacttcagaaagagaagaatattaactaggctatcttggtgatgtgctgaaaaaagtgctgtgtttcctttttaatcattcaaaacaaaggtagtaaaattcccgggaaataagaaataatgcatcataaatgtataaaagttgaggaaaatactatatttttatgaatttaaaatgccatctcatttagattgttatgtcttttcagaagtgctttaaaattgatggcacatagtaaaaaatggcataaattccaacaattaatggaaaaacattaatccatcttcttgagtcttggaaccaggattcttttgggaggcttcggtgtatctgtgtatcatttcattgccttcacacaaatcaaatcacgccacctgcgactgtggtttgaaaaaaaaagaaaacataataatgatgctgtcaattcacttgagattccatgatcaaaattaacctacgaacaaagcacagactttattataattacaaaataggatgtaatttacataaaatgtgaaaatataagcatagaacgaaatttgatacaagtcgaaagctatgacagggactgttggagggaagggaagttgtacactaatctccacatcctactgagccaatcagtggtgttcaaattggatggaccatatattatctaaacagtatattatttaagcaaagaattaagcactgtaagtatattatttagagaaagcaaatttttaaaaaatcccataaaattatatattaaagactaaattggaaatatagttttagaagaagaaagtagggtaaaggagctatattctctaccgttcataaaaagtcaagggatattacttaaaattgttaaaacaaaattaggtgattgtataatattatttacagttcaagagaatagcatatagtaaaaaaagaaaatgataaaccttgcctaactctgaaaaacaggaccaaggtctatggaaggaaaaaaaaaagtttctggttttcactggttttttgcccatcaaactgtttgaatgattttcaatgcacatgtgttggtttaattttaaaatgttcttacttacagatccccttgaattacgtgtaaaattaggtttcctttagtcaatggtgtatgaaaagtaatcaactcatctaattgaagttagacattaataaataataaattggggagaacataaatatactcattaaaaacaaccagaacatagcacttggctctatgttctgcttatctaggaagtggaattcttaaaattaaaacaaaataataaggagcttcacattttctttttcttctttttttttttttttttttgagatggagtcttgctctgttgcccaggctggagtgcagtggcacgatcttggctcactgcaaccttcacctcccgggttcaagcgattctcctgcctcagcctcccgagtagctgggactacatgtgcgcatcaccacgcccagctaatttttgtatttttagtagagacggggtttcaccagattggacaggatggtctcgatctcttgaccttgtgatccacctgcctcggcctcccaacgagctgggattacaggcatgagccactgcacttggttggagtttcacattttctgaaaaatgttagaaataaaaatgcaagtgtttcacttagataaagctctcataatcactggtagactaaagtcaatttagattaccatttatattttcaaatttataatatgaccaatattgccatcaaagtgttcaggcacagaatggtttaaagtagctgtcttattatttctcaatattctcttttcttctatgattggcatcaccaatcatggttggagcatcttttttttattttattttttattttattttatttatttattttgagacggagtctcactgtattgcccaggctggagtgcagtggcgtgatctcggctgactgcaagctccacctcccaggttctcaccattctcctgcctcagcctcccgaatagctggcactacatgtgcacaccaccatgcccagctaattgtttgtattttttagtagagacagaatttcaccgtgttagccaggatagtctcaatctcctgacttcgtgatctgcccgcctcagcctcccaaagtgctgggattacaggcttgagccaccgcacccagccatggttggagcatcttaccaaggaactatacttgtagtttttgagtggaaacaagggagaaattttattcatgccttgacctaattaataatgcgtaactagattctgatggccgttatcaatagaactgtcatcagattcaaagagcactgggccgggtgcggtggctcacgcctgtaatcccagcactttgggaggccgaggcgggtgaatcatgaggtcaggagatcgagaccatcctgtctaacaaggtgaaaccccgtctctactaaaaatacaaaaaattagccgggcgcggtggcgggcgcctgtagtcccagctactcgggaggctgaggcaggagaatggcgtgaacccgggaaggggagcttgcagtgagccgagattgcgccactgcagtccgcagtctggcctgggcgacagagcgagactccgtctcaaaaaaaaaaaaaaaaaaaaaaaaaaaaaaaaagattcaaagagcactgtttgtctcctctaatatggagaaatgccacaaataagtgggaaataatttaatgactgtagttcatttttaatcatatagctgagtgatattttaagtctgacaagaatagatatttgaacaaaaatagccaattctctgttacataatttaatacatttgtgttaagaggtttagacaataaagttaattttgaaatgcattataaataactgagtaattagcaatcattaagtttatttttaaataagtatttagataactaattagcaatcattaagttcatttttaaataactgtttagtccacaaaaaataaaaaatatattttagaaagggagggcattccaaaatctgtctcaggagcattcaatctcaaatatattttaatgaagcagaaatgtaaatacatgtttagataatttaggttaaaaaaggtaaattttggttgcctgcttaacttttatgaaacagatatttttcattcaagtccagcatatattttgctatgactttcacatcctttcctcagagactatttacctaaacattagggtaccaaaggaactaggaaacaaaaacttgttagagagaaaaattttaagtgaggcgcacattctggtgatattaatttgtttttgacattttattaatattttgagaacactaagaaaataaaatccaaaggggcaagcaggtatcattgtctcagtctgggccctcttttgtcatcctctgtaagatggcagtcatcaaagagcgtgacccaagaagaaagtaaaacagtggaacaaatgagcatttctctaaatacaaacagtagagtccctgagaaagaatcctttaaggccttagatttctttaaacatttttagataaatagtctggcctatgcagaacaaaatgaaatggtgataatgaacaggatagtgaagttttgtactaactgacataaacgacgagttgattaatgcttaggatagtgtgaaagaagaattgaaagcaaaatgcaaatcaaaagaagaaatacccagacagactctttcctaaaacatgcatcataaaatatttaaaagcatctgctttaatgcatgggctgagtcaaagtaaggcaaattttcagatatctacaagagcaaaaaaagtttgaatccagaggtgtgagtgtctcatctggcatttgccctggggtgtctcccaggaactattggcccagaaccatgagcacctaattcaggagacagagactgatgcccatgcagggaggaatataggctaaaatgcctcctgcataaatctaggatttctaaagagaagcatgttaagtggggctaggaaaatcccactcccataagaagaaagtgaaaatctatgcttgtcttggtttcaatagggtagacaagaaaaaagaaaaaaaaaatggtaatttctaagtataagtcaatagacatattggtttggatttgaattcacactatctatgggcctgagaaataccaggatggaaattagcctctggcagtgagaggttaggccagctgcacttcctgggtcgagtgcggacttggggaactttcctgtcctacaaggaatttgtaaaatgcaccaatcagcctctgtaaaacacaccaatcagcaggattctaaaagtagtcaatagtggagaggattgaaaaaagggcactctgataagacagaaacgcaacatgggtgggaagaaataaggggataaaagctggccacccgcaaccagcagcagcaaccaggtggggtcaccttccagggtgtggaagttttgttctttcgctctcagcaataaaccttcctaggctcactttttggttccgtgccatctttaagaactgtaacactcaccaggaaggtccacagctgcattcttgaagtcagggagaccacgaacccaccggaaggaaccaactctggacacagtcctgcaaactagttaatctgagtacaatcataaagagaaatatattttgcactaatactgggaaacagattttgtaacacagctttcattgttgttaagtgaagatagtatattttacaataagcaacactgggaccactgatctccataagggaaaaaaatgaaattgaaacttaatcctggagaacaaacataaaaatatattttaacggataaagatagcttctcaacatttttagaaaaaaacctgggaagaattatttttttcttttttgagatggagtcgctctgttgcccaggctggagtgcagtggcgcggtcttggctaactgcaagctccacctcctctcccatgttcatgccattctcctgcttgagcctccggagtagctgggactacaggcgcccgccaccccgcctggactaattttttgtatttttactagagacagggtttcaccgtggtagccaggatggtctcgatctcctgaccttgtgatctgcccacctcggcctcccaaagtgctgagattacaggcgtgagccaccgcgcccggccatatcttttatctttacatggggaagaagaacaaactgaaagaggaaaaattgatttgataacacaaaaatttaatacttctgtttattaaaggatactgcaatgtgaaaaaaaatacccaaaacttggcagagctatttgcaacacatcttacctagaaaggtctggtatccagaatatgcctcctataaataagtgaaaaataacatgtctgttgagaagttagcacaaataccccataagcatgtaaaaagtgctcaacctcataataatcatgaaaatgaaaattaacaattagatatcctttcacacatattgacaatttttttttgaagttctgaaacgtgtggtattggcacggataaagaaccatggaagtattcatcccacacactaaagtaggacagccatttggaaaacagaaagatgctggctcatacagctgatcataatgtaccctatgatccagtgacttcactacaacctagtgcaacctagtcagcctgttacaggccccagaaaaattcttgcgtttgtttacctagagatatatgagaatgttcccaattttaaaaacctggaaacaatctagttatctctcaatatgggtagatagtggactgggtaactaaatgatcatatattccgataatagagtacctcgcagcactaagagtgaatgaactgcagctattcacattctcaaatacagcactgcaatgagatactactgcatgcgtattagaatggcaaaaatccagaaccctgacaacaccaaatgctgatgaggatgtgaagcaacaggagctctcattcagtgctgatagaaatacaaaatggagaacagttttgtggcttcttagaaaactaaatctactcttattatacgacccagcaatcttgtttcttggtatatatccaaaggagttgaaaacttatgtccacacagaaacctgcacacagatgtttatggaagctttatttataattgcaaaaacttggagacaagcaagatttccttcagtaggtgaattaacaaactgtggtacatccagacaattgaatatcattcaatgataaaataaatgagctgttggccgggtgagatggctcacgcttgtaatcccagcactttgggaggccgaggcaggcagatcacgaggtcagcacatagagaccatcctggctaccacggtgaaaccccgtcgctactaaaaatacaaaaacttagccaggtgcagtggcaggtgcctgtagtcccagctacacgggaggctgaggcaggagaatggcgtgaacccgggaggtggagcttggcttgcagtgagtggagatcacgccactgccctccagcctgggcgacagagcaagactccctctaaaaaaaaaataaaaaaataaaataaataaaataaaaaataaaaagagctgtcaagccacgaaaagacacagaggacgcttatatgcatattacaaagtgaaagaagccaatctaaaacggctacatactgtcacttccaactatatgacctttctggaaaaggtaaaactatagagatagaaaaaaaaaatcagtggtttccaggagttaggaggaagagaggaatgaataactagagcacagaggatgcgtagggccctgaaagtacatgtatgatattttaatagtgaatacttgtcattgtaaatttgtccaagcccgagtgtgaaccttaatgcaaactataagatgtatcatgtatcattaattgtaacaaatgcagcactctggtggggggcgtttatcatgagagaagctatgcatgtgtggggggcagggagtatatgggaaatctataccttctgctcagttttgctgtgaactttaaactgctctaaaaaataatgtgtgtgtacatgtatatatatatatatatatatatatgcatacacatgtttgtgtgtatgcatatctaatcacaagaaacaatacatagttggccaggcacggtggctcacgcccgtaatcccagcactttgggaggccgaggtgggcagatcatgaggtcaggagatcgagaccatcctggctaacacggtgaaaccccatctctactaaaaaaaatataaaaaattagccaggcgtggtggtgggcacctgtagtcccagctactcgggaggctgaggcaggagaatggcatgaacccgggaggcggagcttgcagtaagcggagatcacgccactgcactccagcctgggcaacagagggagactccgtctcagaaaaaaaaaacaagaaacaatacacagtttcacttattaaaaaagtcaaacatgtgcaaaactaaacaatatgcaagtctacaatgacaagcaatggaatgattaacaggaagttagggatagtggttacctcttgtggaaagagtgagtggcattgaagaagggcaatgggagattctaagatactggaaatattctatttcataacctgaaggaagggcgcatatgctcattttatattcttcttaagctgtacacacacacttttatatttatgatctatttcattaagtaacaagacatatatatgcatttgtaaataagtgagattaacacatttttggatacatataacatatcaaagttgactcaaataattagaaaatctagatggaaatcataccattaaagtaattgagttaataattaataattctacaaagaaaacatgatgcctagatgatgtcaccagtagttccaatgttacactaataatctgcgaggggaaaaaaaagagaccattctttaattcatatgatactaggataaccttgctatggtgtacctcatccatgcacacagacaaatagtgtaaacaaaatactaggaagtatacctagcaaagtataaaaaccatgaacaagctcggttagtaatgcaaatttagttcagtgttagaaaatctactgaaattatctccttatcaacaaattaaagacaaaaattatatgattgtctcaaaaggcctataaaattattttacagctgggcacagtggctcacgtctgtaatcccagcactttgggaggctgaggcgggtggatcacgaggtcaggagattgagaccatcctggctaacacaatgaaaccctgtctctactaaaaaaaaaaaaaaaaattagctggacgtggaggcgggcgcctgtagccccagctactcgggaggctgagccagaagaatggtgtgaatccgggaggcggagcttgcagtgagccgagatcccgccactgcactccagcctgggccacaaagtgagaatccctctcaaaaaaaaaaaaaaaaaaaatttacaaaaattaaattattgatatttccacctatgaataaagggtaacttccttaacctgataaaaggagtcgacaaataacctacagcacctatcatgttttgtgattaaaaatattgaaatcactccttttaaaatcaagaaaaagacaagagtaccattgtcactaaactgcttccaaagcttatacggaagagaaaagggcccagtataactaagacaatcccatagaagactaaagtgtgcgaaggtgggaggtggagcttatgtgagtctatctcgtaccagatttgctgtgaagttataattaccacagcaggaattgctattgtgaaagtgtatgcttgtgtgaaatcttgatgtatgccctggctaacattacagaacagtcagaaagggtctatatgatccatggtatgagcaattggtatccatatgggaaaatatcagaatgcatctctatcccaaaaatggatccctatcacacaaaggccagatctaaatggacaaaggacttaaatttgagatgcaaatatttaaaaatcttttagaagaaaatataagagggtaacttattacatgccacacctactatgtgtactttgtacgatgcaagtgttggatatgagtgtagtatgtaagtgtagatgcctctaagcagtatatgcatgcttgctactttacacacgtgaaacactgggaatgggagcatgagaggaaaccctaggtcattctggtctccagactgctgctcctgcccacccccggttccagcactcccttccccattctcctatccagatcctctgttccaggcacagccacttacagcagctcaagccagtggcacccacggagaggccctcttcaccctactgctgggctgtcatgtcccctttcttttctttctgaaaaacagttttctctgcctatgactcctcatgtttcactctctctaaagcacatggaagcctggttccctcctctgctttatcagacctgttgctgtgagttccactagtgaccctgcatgacaaattcggaggtttgctcccttttgcatagcgtaaaatgtttacctcgtgacatacttgataaatacaattttataattgttaagctatctatatattctgtatctgtttcaaaaattatttataggcgaggcaaggtggttcatgcctgtaatctcagcagtttgggaggctgaggtgagaggatcatgaggtcaggagatcgaggccatcctggacaacatggtgaaactctgtctctactaaaaatacaaaaatcagctgggtgtggcagcatgcacctgtaatcccagctactcaggaggctgaggcaggagaatcgcttgaacccaggaggcggagattgcagtgagccaagatcgtgccactgcactccagcctggcgacagagcgagactgcgtattcagcccccccaaaaatataaagacaatgtcaattatgccacacataggttgtttttattccataatattgctctccatgtgtgtaatatgtttctacttcacacatagttttgatcaaagattaatctattgcacagatatttttcttagtaattaataaaactcagcttggatttctttagctagataaaacaccttatactaagtgaatcaatcaaagctctttgttggagtgagatctgaaaactttcgctcaagctggctgcctcagcttcacggcatcaaataatggagggagaagtggaggctgacatgcagcaagaatgactgtgtgtgtgctggagagatattttgtttaattcatttataagatactcatgccacactgctacgtgccaaacagctgttcttgctacttggtaaaaattaatcatctaatagttgaaaagttaattgttgtaatgtgacttcagtatggccaatctctgggattgagagccaaaaaaaagcatcaccatcatgattgagaaatggagttactggcagtaatggagcaaaccacgattctgcacttggacacagaattattcctgacaagatcctggctcctaactcttccaccaaaaccgagtctgcagctcccacactgaaatgccgctcatttcaccccaagtgtgttccagccattccttcttctccttcctaccagctctgtaatgtctccatcacaatgctaaggtcagggtcaatggcacttcgtttcagaaactttctgagagccctggaaagtaatctcttcttgttcttattccatgatctcctgcaccttctttaaatcactgatgatcatttgtgtagatgagttgtctccgtgtgtgtctgacctttctcccagttggtgagttctggaatccaggaagcattttagtaaagtaatagtttttagtaatttagttcacctctgtgcaccctacagctgtttctcacatgttggggctgcccagtgagcacttgctgagggaaactgcagggagacttgcaggtcaggttcactgagccagaaagtgaagcaaactgagagggcaaagtgcaagacactggctgaaatatatgaacacactggggaaagaaacatccccggcctctgtggaggcggaacacagtcgctgaggtctgtgattcagcagcacccacctggcaaagcatgctcagcatccggcttcgttctcccatagtgctttcatggtgaggaagaaaagctatacatactaacatgggccagctggaaaccacagctatatagtattgcttttcagcttttcagctggaattccgaaagaactctgaggtcatgcagaatgcggcatattgttagatggggcctgggtgggcttggtgttagaggacctgccccaggtcatggtctgtggtggggagggagggtgcgatttcccatccccttacctctttgtcccatcttttttgccctgtacacacatgatcgtcctcaatatcttaagtagaatctcccatatagctaaaattgatattggcatctaaagtatgcctaacttagctgaatatttggcctttgcctttaaaggatctgtaagttattgggatgagaccaaggagaaaaaggaagaccatagataagcataatctgccatccaataatttcatgacatgcttatccttggaataaagttggactgttgtcaggaaactgtcccaccatttttgttgcatgtagagacctccattgctatggcctccattgtaatgggctgtcattgggtttgaaaaaagtctacatgttgattttgatggcaataaaagagtcagaggtgcaagctggagcaaggtgctcgccaaagctaggcctttcccctccctcaggaactggcaacaagagcaagagttagcttcctgaatgtttgcatttcaaagagacagctctcaggtctttgaggagacaattctgggatgtagatttacacttcaaaggcagagaaaagatttataattgcaagctttctaaggttctaagaggggattcggggctctacctgcccatcaccaggttttgcctgaaacaaacagtaaattctccttgcaagtgagctttctcaggcagtcattttaaggagggctggggtcatctgtgggacatccttgtgctgctggaagcctcactagagtttggtcctctctttgggcaggggtttggaaggagtagttaagtactgcgaggcctgcgttctcatgaccaaagttcacaaatgcccatttccttctttctttctttttcttttttttaatatttaaaaatctttatgtgtctattaacaccttttggaaatttccatccctttcaaactatgttccagtcaaacaaaacaaagtgtggcccagcagccctggggagtctctgggtgaaggggagatgagcacacaaatgttgagagtttgagaacccctggccttgatctttatgatagttggtcaagtggtcatcagtgaaatccacagggattccctgagagtgtatagctttggcatgatggttgctgtaatctgaaggggaaagtagaagtttacatgtgagcactgaagaagcttgagactgtctcgctctgtcacccaggctggatgcagtggggccttctgggctcactgcaacctccacaattctcctgcctcagcctccccaatagctgggattacaggtgcctgccaccacatctggctaattatgtttttctttaaaattagttttatttaaaaagtacaagtagcatcttagttttacttttgcaaaaagtaaagaaatggtgtttcgttgcaaaaattaaacaaataaattttggattgtagaaaattcattaaaaactcaaattttaatttatttaaaatctatctggtgctgtaagtgtggctattggcagatctctttttatttatttttattgatttattcatattatcaataactaatttttaaattattattcgtgagccctttcccatgacagcttcttggaaatttctttctctcccattaatctagtatgatctctcaggcatatttatttaaagttcttcctctcactattcccttcttcaccatcatgcctaggttagttacaaagaactaatttaatgacccatttattctgaagggaggcacaagaagtgaagcttctttctgaggcctgaagggatctcacctccttaaatctctgtttccctacccctacttcagatattattgagacattatattttcttcctctaccttcagaaatttcagtatcaacaggtccagatctgcctaagccctcagatgagtctgcaaacaatcattgtgtcaacatttgactcatgccttgcagatgatcccaggcaccgctgtcttaacctgtgaaaactgcaaattcttggcacaaacaacttcttctgcacatccctcctcctcatacatacagtaagggacttggccaaattccaacacagcctctatcagctcagagccacgtccctacgatgccccatacccctctaaagcacctgcctgggaacattcaattctgccaaaagaatttactgtttgtcccacccaaaacttgactataggcccctgacctcccatttctaagagccttaactttagaaaacttgcaattatggccaggcgtggtggctcaaatcccatcactttcggaggctgaggagggtggatcttgaggtcaagagagcaagaccatcctggccaacatggtgaaaccccgtctctactaaaaatacaaaaattagctgggcgaggtgacacacacatgtagtcccagctacttgggaggctgaggcaggagaatcacttgaacttgggaagcggaggttgcagtgagccgagatcgccccactacactctagcttggtgacagagtgagattccgtctagaaaaaaaaaaaaaacacaaaataaaacagaaaacctgtagttataaaccttttctctgtccctttaaatctcctataacacagaatgtctttctcaaagacttaggagctatccctttggactataaggatcaagaaggatacaggattgtctcctggtctctgtctctgcgtaggaacctaactttgataagcactattagcaaacacagatggcctcatcacattgaccaacctttccccaaacatcagtccatgcttttcctttagcacactccaacatttgcagagcctcttgctttttgtttcagtggagttgaggctttctaacatactataaattgatatgtctacttattgattagaagacagaaattaatcactggatttcattatcacgctgacttttaggattaaaggcagcctgtggttacagatgcaacatctttacatttcgaagaaaaacaggagagatttgtctttggctcctttggacctcactgagtaatagaaaagagagaattgaacaggtttggatgatacagcacaagtcagtttaaagttccaggcaaagaaagcaacggttatttttcactccagagagtgaatcattctttggggccacaaaagagaagatttgaagaataagcagggacatctagaaggtggctgagtgtactccatcaggttaaattaagctattttgttgttgttgttcaaatagcttccccacagggtacatttcatatctaaagtgctattccctctcccatcattttattacatacgcaatatctggctgagaacctctgtcttgccctccttcttactggttaagaacacagacagtcctctctttgcatagcagtgcagggccatacaaatcactatgtaagctaaagatctgtaaagtgacctaaataatccatgtgaaacatcgactgttctgtgtcatttaaaaattttggccaaaacattaaaaatctcttactgttggttataaatgtataaggaaatgaaacatagtgaaattagtacttttttttttttgagatggagtctcgctctgtcgcccagactggagtgcagtggcacgatctcggctcactgcaagctccacttcttgggttcaagcgattcttctgcctcagcctcccaagtagttgtggcatgccaccacaccaggctgattttttctatttttagtacagacagggtttcactgtgttagccaggatgatcttgatctcctgacctcattatccgcctcagcctcccaaagtgctgggattacaggagtgagccaccgtgcctggttgggagtacttcatttttacactgtaatttaaaacattaaacaacagccaattaaagtgctttatttatttatagacgtgtatcaagcccagtttgaacagtgcttgcctccctcttgtcgtatagcttatgataaggaaccagcagtgtttctatgccttggtgaactgtcgtgctgttttcggaacagcatctaacattgtcaacgtcatgcaatatctacaagagttcctttaatatgaagtttgttgctgtctttgccggcatcacttcctctggggcttcttcatccttttcatcacagctgcgttcctcatttatgtcagaacactgcgttgcgccaagttcctcttgctgcgtttcctgtggtgagccaattctatgattccatttacattgtatttgaatacacttccagggttatcacattttttatttctttgccgcacatcaatggttgttgaccagttttttcttctgattattcatatttataaatgtcacatgggtttctcactgggagacaaggagtcaacacgattgcagactctgctgtctgtgtgcgaactagcagatgcacagtgagcagtcactgacaggctttgaaggaggtgaattgtgtccccctaaaaagatatgtttgaaatcctaatccccaatatctcaaaataatatgatcttatttggaaatagcacatttacagaggttctcaagttaaaatgaggtcattagggtgggtcctaatccaatagactaactgatgtcttataataaaggagaatttggatacagctccagacacacacacaaaaaagacgatgtgaagacacatagagaaaacagagtgatatatctgtagatcagacaacaccaaggatggctggcaaacccaaacaggaaggagaggggaagaaggattctcccctagagccagcagagagcgtgaacctgccaacacattgatttctgacttctagcctccacaactacgagtcaatacatttctgttgttttaagcaacccggcttttcatactttgttgcagcatccccacaagattaatacagtccctaatcatgatgcttgcctgttatttactcacataggcatttgtggaattaagagctgggaatgaagtttggattttatgcagttgctcacagttagcatattgtggtaactgaaattgtaaccacgtttttgggagactagtgctatttaactaaactatgttaattaaacctgtgcatattcaaatgtgcaaagccaggactgtttttacttagttcaggtatttagagggaaagaatgtttgcctcttttcagggccttagagcatgccctgtgccagcaggccccttccacagctacttaacatctcttctcatcttgccagccacctctcaactcagatgaccagcaaggccatcttggactatcaaaatgaagtagcccctctccgcttttgactacgttcacttgctttattgtctttatagcatttttatttactaaaataacatttttttcattacttgatttttttcttgattcagtacttctaaaaaatgcagattaaaattccaatgacaaaccaagttaactaatgttaaaaagtgtgatactggccaggcacggtggctcatgcctgtaatcccagcattattggaggctaaggcaggcagatcacaaagtcaggagatcaagaccaacctggctaacacgatgaaaccccgtctctaacaaaaatacaaaatttagccaggcgtggtggtaggcacctgtggtcccagctacttaggaggctgaggcaggagaatggtgtgaaaccagaaggcggagcttgcagtgagccgagatcacgccactgtactccagcctgggtgacagagcgagactctgtctcaaaaaaaaaaaaaaaaaaaaactgtgatactattaggtattgttgagaatatagatctatcagaacctttaacttctaatgggagcataaatcggaaaacagttcattttaacttagtgtacaaatcttttgacacaatgatttgaatgttgggtttataccttagagaaaatctaactcttatgtccaggagactcatacaagaaaaggacatctactttttgtaacagaaaaaaatggataataaccccaatctaataaaatggaatgctcattatagtattatcctgtgaaggaatactctaaatcaatgcacagaaagtacagataagaatatcataagaatgaatcttacaaatttaatattgaaccaaaaagcaatttcagaaaaatatattcagtgtgatcccatttgtttaaactgaaaaacatgtaaaacaataatgttcaatgtcctttactaatgcatttattttggcaaaattataaagacaagaaatgggactaattaacaggacagtgttaaggactctaaaaatatgggtagtttttgattcttaggcaggtaatgtgtacatcagtgttcattttattatttcttacgctgtcttcatgacttacacatattttgctagttttaaaacataagatgtgataataatctaaacagaccaaaggaaaaaaatgaatatgttaaaaaaaagacagagaatgagccctgtctgatagaaagcataacaaagcaagtagaagaactctcacgaatgcttgatccaataaagctaggtttgtgatccacaacacttcagcattttaatgtgatttttgatgtttgctttttgcaacggtgattctcagttgcctccctcctatgtctttacaagctgaaatcaagtgaagctacttctgactttttctaaaactaaaacacaacatgaaggtctgcgtattctttcacatgtgaacgtatgtggcacttttccatgatgcaacagcagcgggtctctagctaagctacagcagcagctctaagaggcagaggaccctgaaatgaggctgaaagaaagaatagtccataactgacatcaggcaggctgctgttgtaagcaaagaaaggaggctcacaggggcgcggactcaggccaggtcaggctattgtgggagaacacggagcacacgtgtcagctggaaaggggccggctcaggagacaaaataggcacgagaggaaaccgaaaaattgacatacatgactatccttgtagaaatgtataaaggtttggattattttgcttatcgagttataataaacttattctaaaaatgtttatgtaaagtattatgtacatttttgttttaccttataaagattatttatatttgaattgtgtggttttggaatgacagtatttataaagttggttttgacattctctacgatgcttaatgaagaaactgacgttcaaagagattggttaattccctgtggccagtggctgagctgggacagagttcaggttttctgattctcagcctatgttgttttctcttcattttaatgtgaacctaaatatgtataggatctagacaaatatgacatgtagtgccttatttcttgttttctctgtaatgaatgccaggtgagataactttatttacaaaagcccatccagtggctcaggttgcatctgtagttgcctttgaatcatttattcaacgtcaggatggtaaagtgaggagcttccccaaactgaagcagagtggcatttgtcccaggttgtagagtgttccctgccataaataaagacatgctggttcttgttatttatacaggcactggggttcccattagctcttacatttcatatgcttagagcaagaagctagagagtgacttaggatacagtgtaaagatagtaaattaaggcagttctgcaagatttttaggacttctttttttcttctattcatcatttatgaagtattcttgctggaaatagtttatgtctctctatcttgctgactgatgaatactcggccaggatgctaaaatgtggtttcatgaagtatgttgtgtttctgtctgttcttgtttccttccttgaaatgtgtaaaagtgaaaaacatattaatcataaatcaagcattcatcataagcctaaaaaaagataaaataatcagtagtatcattgactaaaattattactcaccaaaagaaactcactccaaagttagcacaatactaacagagaatcctagtttttccaggaatcactgaggcatagtacctcacatgggaaacatgggaagtaaaaccacctgaggagccgcttgatggtgagtcaggctgttcctcgaagagcaggctgtgactgccaaactttgtaggttaaggagtatttataatgatctttgaggaaactgcaactgacaattgaggaaaaaaaatgttagttcatgactgcaaaatacatgacagaatcacaaaaagtattttacaagtttaaaaaacaaacctgatgctgatgcaaggtaggcgaaccccaaagtggggcttagcctgcaagggttcttggcttcacccaggaaaggattcaagggcgagccagtggtaaggtggaagaaaacacctttatcaaagcaacactgttacagctcctgtggggtcacagctcagtgactgctcccagggttgccccataggcagggtgtcgagagtagtggctgagcccagttttgcagtcatatgtatacctacttttaattacatgcagattcagggatggtttgtgcagaaattgttaggaaaagggtggtaatttttgggtcatcaggtcattgccgctgaaaggggtggtaatgcctgagtgttgccatggcaatggtaaactgacagggcacactggtgggtgtgtcttacagaaagctgcttccgctctgtccttgtttagctagccctcaatcttttgtttgtaaattagcaagagagtcatggtcttggcgttttatcccagaagtacagtggaccccagagcactctagacccaggagccaaaccaaatcacagcatcccacagctgtgtccagccctccatcactgattggctgcaatccaacaagtggcccagaggggagggttcattgaaagctctttgctaagtgacaggcctttaaggaggaaaaggctcttaaagattggtatgggatgggggaagtgtttgtggtcaccacggcaccccaaggctgtggccttctctgagcaccctgagactcagccatgtctttctctctgttttcccacaaaaccagccagtgctaaagcatatcctcctggcctacaaacagtggccatgacttccaactcatccaggctacttctgatttagtgttaggccgcccacttgatgtgtatgttcccatgctgtgtcgaccctattacttaatgaaaacacacagcactcgtttgcttctcaacttacttctcatgaaatattactactcctccccacccaatcacaatcctttgctgccaaaaatcccttgctaccctgtacattttgcccaataagggaacccctcagcacacacacacaatggcctactcagaaggctgagtcagcagaatcacatgaaccagggagttgcaggttgcagtgagccaagatcgcgccacagtgctccaacctggcgacagagcaagactctgtctcaaaacaaacaaacaaacaaacaaacaaaaaacaaaaaaaatgcctcactcatctcacttatgtaatcatgacagtaccattaattgtattatccctataatacagatgacagctgccaaaaatatgcagagaagggttaattaaactgcataacattactcagagaatgcattctttttattccataggtttttctattacagtactacatacacagaggccttccattggaaataacttataggaattattgtaggtctctttgcactttcttcagctcttggtttaggtctcaaattgtgagtgatttctctctttagtgaagttgtaatgcaattcattaccatagcagaaaacacagaaaatattacctatttattaactggaaatgcactcacatcttgtattagtccattctcatgctgctatgaagaaatatccaagactgggtaattataaagaaaagaggtttaattgattcacagttccacatggctagggaagcctcaggaaacttacaatcatggcagaaggcacctcttcatatggtggcagcagaaataatgagttttgagcaaaggggaagccccttataaaatgatcagatctcatgagaactcacccaccatcatgagaacagcatgggggcaactaccccatgattcaattatgttcacctgatcctaccctttacacttggggattatgggaactgcaattcaagatgcgatttgggtggggacacagagccaaatcatatcattctgtccctggcccccctccaagtctcatgtcctcacatttcaaaacacaatcatacctttccaacagttccccagagtcttagctcattacagcattaacccaaatgtccaagtccagagtttcatctgagtcaagtcccttccacctatgagcctgtaaaatcaaaagcaagttagttactttgtagatacaatggaggcacaggcattgggtaaatacacccattccaaatgggagaaattggccaaaacaaaggggctacaggccctatgcaagtctgaaatccaatagggcagtcattaaaccttaaagttccaaaatgttctcctttgattccaggtctcacatccaggtcacactgatgcaagaagtaagctcccatggccatgggcagctccacccctgtggctttgcagggtacaaccccctcctggctgctttcatgggctggcattgagtgtctgtggcttttccaggggcacagtgaaagttgtcagtggatctaccatgctggggtctggaggacagtgaccctcttctcacagctccactaggtagtaccccagtgaggactctgtgtgggggctccaaccccacatttccattctgcactgtcctagcagaggttctccatgagggctttgcccctgcagcaaacttctgcctgggtatccaggcatttccatacatcctctgaaatccaggtgaaggttcccaaacctcaattcttgacttctgtgaacccacaggctcaacaccacatggaagcctccaaggcttggagcttggaccctctgaagcaatggcctgagctgtaccttggccccttttaactgtggctggagctgaagcatctgggagacagggcaccatgtctcaaagctgcatagaacagggggtcttgggcccatgaaaccatttttccctcctaggtttccaggcctgtgatgggagaggctgccaagaaggtctctgacttgccctggagacatttccctcattgtcttggtaattagtattccactccttgttctgcaaatttctgcagctggcttgaatttctcccaagaaaatgggtttttcttttctatcgccttgtcaggctgcaagttttccaaacttttatgctctgcttcctcttgaacactttgctgcttagaaatttcttccacgagataccctaaatcatctctctcaagttcaaacttccacagctctccagggcaggggcaaagtgttgcagtctctttgctaaagcatagcaagaatcacctttatcccagttcccaacaagttcctcatctccatctgagaccacctcagcctggacttcattttccatgtcactatcagcattttggtagaagccattcaagtctctaggaagtcccaaactttcccacatcttcttgtcttccaagtcctccaagtctctaggaagttccacactttcccacattcttctgtcttcttttttttttttttgagatggagtttcgctcttgttgcccaggctggaatgcagtggtgcaatctctgctcactgcaacctccacctcccatgttcaagccattctcctgcctcagcctcccaagtagctgtgattacaggcatgcatcacgatgcccagctaattttatatttttagtagagatggggtttcaccatgttggccaggctggtctcaaactcctgacctcaggtcatccacctgcctcggtctcccaaagtcctgggattacagggatgagccaccacacccagcctttactgtcttcttctgaaccctccaaactattccaacctctgcctgttgcccagttccaaagtcacttccacattttagtgtatccttataacagcaccctatgtctgtggtaccaatttactgtattagtctgttttcatgctgttatgaagaactcctcaagactgggtaatttataaagaaaagaagtttaattgactcatagtttcacatggctggggatgcctcaggaaacttacaatcatggccaaaggcacctcttcacagggtggcagcagaaacaatgtgttctgagtgaaggaagaagccccttataaaaccgtcagatcttgtgagaactcactatcacaagaacagcctggagaaaaccacccctgtgattcaattatgtccatctggtcccacccttgacacataaggattatgggaattacaagattacacattaatcttaaattacacattaataagtgtgtaatgaaacatcccctttttttatttgagttcatttcaatagatatggaaataatagaaaatgcatctgacatcaaattcctgggaagtacaggcaaaaaaaaaaaaaaacaaaaaaaaaacagatctttaaaggtatttgaataagtaaatgttgcagccaaaccatatcacttgttaaaaatgcacgttaaccattgaatcaaaaccatatataagcttagataattcaatttcaaccagattattccttttattctttaaatgatggagaacattatagccataggctcgtgctgacaatttttccttaaatgaatgaaaagatgaatttatttttctcaaagaattcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaattctgcgtgctattgaagcatggttctttccaaactcatggcaactatacctcagaattaaactctataattaaggaagaaaccctcattctccctgtaataactgaatacctaagcacattaaaatgcctaaataatctggtattttcccataagcattctgtaaagtttttcttaagctatgcggcagttataccctttgcttcctttaaaacaatatgaatgagcattttaaagagataaatggaatttataagctatcaacttctcgtcattaaaaaataattaaagctgatttaaaaaagaaacatccctaagtattttgcaagtgacaattcaagacagccgaaattcaaaacaggagagaaacttttttgaaagacatccctatataatgtaaatttactctagcataattgagtattttcatttgtgcaagtaaatgttttaccaagtacaaggtatggaattaatatctgcaggagatggacattgctaatctttatttttttgccacttatggcatattgatttaaatagatacatatatttgtatatgtctggtgggattcactcaaattaataacaatacttaaatatagggcacagactaggtttggaatggagacaaatattgaggaaagtgactagaacttgtgctttatgtgaactgtttggctttttaaatgataatgtatacatgtattaatgtatagtatatattaattgaatacaattgattttaattgtataattaattatatacaatgagttatatacaattaataattatatacaattaattagttgcacataattgatacatgttatacaattagaaatacaaaataacctattcaactaggtgtggcagtctagtctcacagtgaatgactgtgggcttggcaaatttctacctatagccatcaattattagatgagactgacacttgaaatactttttcaatctcctgatattttccctcagaagtttttggagttatattttgattgcagtgaataaccatggactaatataactcattgattaattgcaatattaaatgcaatcagacaatgctgagtgtggtggcagatataaattttccaggtaacacacaagattaggcttctgcttttaggtaagatactatgcctggaggatgaaagatacacagaagtaaaagatgtggtccctgcaccaactctatgaccttatcaagacattcagcctctggtgtgagaggccactcaactcctagaaaatgtgtcacagcggctgggcatggtggctcatgcctgtaatcccagcacttcgggagtccaaggcaggtggatcacaaggtcaggagatcgagaccatcccggctaacatggcaaaaccccatctctactaaaaatacaaaaaattagccgggcgtggtggcgggcgcctgtagtcccaggtactcgggaggctgaggcaggagaatggcgtgaacctgggaggcggaacttgcagtgagctgagatcatgccactgggctccagcctgggcgacagagcaagactccatctcaaaaaacaaaaaacaaacaaacaaaaaaaagaaaatgtgtcacagctttataaacagggacccttctagtacaaaaatcatacttcatgcttcaatctgtgagagtcactcctggactgtctcctcttttgcccagatcctttacagaacctcaggactgggagcgcagaattctcattgcaagtatgaagtgtggttttaacactccacagcctgcctttctcctgtggcttttgtgaaaatcaaatgtctcacggaagagttcttaaaagtttcaattaggaactcaggatgagcaagtggaactgaggactttgcatctctgtttccttgaagacccagggatgggcgaaatattcctgaggagaagttgctcagaaacgtcagtagagatatacagaaagaaaactctaaaagttaaaaacaaataagaaaaaaaaggcttttcagattctgtgatgttctaattataacaggttagaggtcaataaaacggcatggcctttgaaattcacagagggtgattcttcagtaaagacagatgatttttaatatggcagaggcagttgagaagtgttagaatatgccatcccttagacattgttcttacacttaaatgtctaccagaagcatgaggaaggttggttacaagagactcggggccccatctccagcgattctgatttagtaggtttgggtaaggcctgagagtctttacttgcaacaggttcccaggggctgtgggtgctgctggtgcatggaccaccaatcaggcatcctggagccaaggctgtggagccaacctccttagctcaactcctcatcttcccacaaactagctgggggccaagttacttaacctctttctgtcctcaactctgcaatgaagataatagtactttcttccagctgctttagggttaaatgagttaatatatgcaaagcaatagcagagggctgacataagtactcaatacattaatacttttacaattattcactttacaatcatcatcaccaccaccaaagaaaatcacagtcattgtaagagatcttaaaggtcctctagtttctagctgatatcccattacctcttcaaaaatcttgccatgtacaatcccatgattgcatcatcccagtgattgttaaaaaatctttaaataccttaaatgcaacattgacagcctggcaaggggttgtttttccacctttctttgactgagaagattctcagaattaaaattatggtccaactcaagtaatggaacaagctgttaacatcatgcatttttaatttaatttagtttctaccttttactatatctgattctcctagacttatttccccattgcttgccagtttcttttttcaatcctatgtgtaccacgtatttctgtgcactgtctcaacacccttgtattaaataaggtggattaaaagtaaactagaaattgaatgctgaaatatctcttctgatgtgtttgcatgattgcaaatatgcagatacatataaacaactaatcaaaatgaaatgacaaagagatgctgacagaaacgagagggaggtgtgaggcttacaggaatggcaggtctcgcccgtatagcctgtgcccagacaatcacaggagaaggtgtcccacgactgggaacactcgcccccatgctcacagtagctgggcaagcacctaaaagaaaacagatacaactgctgtttccctttttcaatcatcaaaaaataagtgtcttaccaaaaacaggttaaccaaaaacaggttaatgtgaaagagcagcatacgcaagataaccccacatgacgtgattactgggtctgccatcaaggttctctaattatattgacaaactttagataaatatatccattagcatgcagctgattattaggtttctgagacagctgaattttcaacacatttctttttttctttgtcccaagtgacacaataacttgacatgtggctagcaaaaccaattacatacataaaactatgaaatatggcatgctccgttactatattgtggtcatttttaaaagaaagaaggggaaacagggaggaagatacagaggggagaagaaagaaacaggaacagcttcagtcacatagtgacagaggttcagaaattttgaagaacatttaatttaggtcatcttgtcaccttttagatttgcaataagcagtcggttattgctttttaagcaatcttaacactggtaatatgtcaatatgacccaaagcaatctacaaattcaatacaattcttattaaaatcccaatgcctttttttgcagaaaacaaaaatccatcctaaaattcatagggaacctcaagggaccctgaaccagccaatgttgaaaaagaacagttggaggtctcacactttcagaattcttggaatctgctgccgcccactataatattgggggcctagcatgcctgcctctcaggattgttaggggaacagggagcagggtacactatggaaactgaccagcacctgacacagagtgtcaccaagaggtagtgtgaccttctggaggcctggcctgaataccatgacccacctctgccttgagcagggttggatctcagcctctggccgctgtctcccactgctgagtacacagctaaggacctggtaaagagtgaagattctaaaggacactgaccttccaggccgtgagggacatcatagtccatgctggagtggcagaggcggggagcaccccagtgcccctcaccatgggacccagagaagtaacagaagaggggccgggaggttgtgacaggcctcctggctgtggtggaaggacgaccagcagagaactggggtatgaagttgacagaaagccccaggggcctgtatttggcctcgggagagatcctttgaggggaacctgaggggctgggaagaatccgcagcattccctaccctccccatgcccccagccccctatcctggctctccagcactgcaccaccagctcagggccaagacttccataattacatggtgttaatgagcatttagtctgcattcagagaagagttaggggccatgagaatcacaacttttcaagtatttcaaaggccaaggcatggaaaagcctgtgtgaactgatcagaagagggggagctggagcgacaggcaaggttggctggggtgggggcccaccctcataccatttttaaaagagcagctgttcctcttcccccacatccttctccctctcctccccttccttcttaatataatggagcatcttaagatcatacctgacttgaagattccacaaattttaaaaaacattaaaaaccactgctgtttgatatcaacagggagagaataactttagttcaaaatatttggaaataagaactatttaagtgatctagagactatcaacatgtatacactatttttcttcaactaaacacaacatcaattgtgaaaaatttacatgtattacaaataatagaggaagtagctagcatgcagaagaccaacagaggggaagatggcagagggagggcaggagtggggtcagaagcctggtcagcacagccaggtgaggaggtgacggaggcctccctgctcagggagccccagttggaacgcagcacaggactccactggaagctctgccatgtggtatacagggcaaaccttaaaacagtataggaatttgatgtaagaggtgattaagaagttaaaacctatcctggccgggtgtggtggctcacgcctgtaatcccagcactttgggaggctgacgcgggtggatcacgaggtcaggagatcgagaccatcctggctaacacggtgaaaccccgtctttactaaaaatacaaaaaattagccaggtgtggtggcgggcgcctgtagttccagctactcgggaggccgaggcacgagattggcatgaacccaggaggcggagcttgcagtgagccgagatcgtgccactgcactccagcctgggcgatagagcgagactctgtctcaaaaaaacaaacaaacaaacacctatccaaacataaacatccattatttgtgactctgtcatccaaagtgcccattgctattttttgcgtagcttaaaattttgactaaaaaagataacttcataccccttatctgtccctaagtaggatttttaggtctggtatttgagtaacatatgtttctactttgtgagttagtgatatggtttggctgtgtccccacccaaatctcatcttaaattgtagttctcataattcccaccgtgtcatgggagggaacctgtgggaggtaactgaatcatgcgggcagatctttctcaggcttttctcatgatagtgaataagtctcacgagatctgatggttttataaaggggagtttccctgcacaggttctcttgcgtgctgccatataagacgtgtcttgtttctccttcaccttctgctatcattgtgaggcctccccagccatgtggaactgtgaatccattaagccttttttctttataattacccagtcttgggtatatctttattagcagcatgagaacagactaatacaattagatttttgtttgtttgtttgtttgtttgttaacaacaacaaagaaaggctgatagatgcttacaggcctgttttcaggatacttaaaagtgaattttcagtattttcaggttttgaaaactttatgtaaagggaacagcaaaggtctttaattttaactctgtaggatgtcattttgtgtccccaaagttttctaattttattgctttataaaattcaggttttcaaaataatctcagaggagctagtcttctacgttactgaatttgggaatgaaatagtaaatagcctttatttgtagccctatttgaaaatgatttaaaagtgctttcttaaaatccttatctgcaatgattattgtacacatcatggctgaagtttaagtgtggctcacacatacatgcttagttgagcatgtttacaagtaactttggggtacaatttggagggctttttaaaatgtgggatcttagataccaagttaggcaccaatgtaactcttgggactttaaggttaaaacaaaacagcctataacagtaaaaacaatagttttgtactttgggagctacatgcacaaagcaggcaacatggatcatctctgaaaagaggcagcctcacaatatatatctcataacagaaacactgcaaatggatcatattttgtgagtaattaacaaggtatcaaaataatgtcatacaagtgaagaaaatcacacttgcatcacagttgagctgacagctgttgtcactcacagtgtgggcccatgggacattaccccttaactcagagagagctgagctccctggctagttagctgagcaacttgggattatattaagtgagcaaatggccagaaaccttcccaactacccttcccacgactacagagtggggttctggagctggtgttgagatgtaaatgcagtcccagctgtgtgccaagaattcaaatctcaaggtcaagaatgagaggtacttgacaaattcttacacttcatatactcctcatctttgaattaattcatttttcctacaaatcaacagaatgttcacagggggaaattattccatgctgaataaataaagtccatatgaatgaacttttcatttagtagtaattgcgtttttttagtatgtcactaactgtgagttataaattaaaacctgtttagccagagaggataattttacagttaatgtttaaaacagaattgactaactgaatttactccatgaagaaggcaggttttgaaagttctaccagatgcagatataactttttttttttttttttttttgagaagagtctggctctgttgcccaggctggagtgcagtggcacgatctcattcactgcaagctccgcctcccgggttcacgccattctcctgcctcagcgtgccgagtagctggaactacaggcgcccgccaccatgcctggctaattttttgcatttttagtagagacggggtttcaccatgttagccaggatggtctcgatctcctgacctcgtgatccgcccgcctcggcctcccaaagtgctgggattacaggcgtgagccaccgcgctgggccagattatcgctttttaatttttaaatctgtagcatttatttattcactgaaagtaaataccaaatgtactggggcaaattgtatgtagaaatattatttttccaggtgtgaccctacgattcttctcagccaaaatctttgtaaaattatggcacaactagcataactgtggttgtaatacttatttgaattaaatgtttttcttgtctaacctccatatttcattgagtatgtccttctgcacacatcttcatccgtctttatgattcaaacttttctagcagaaattactttttattttctctgcagaacatgtggggttgggtggctgatgaatagtaacctggcaaattcctctgcctggaaaaatatcatccaactgatgggtgtgtggttgcaaaagcgagctttataactattagctgagcaactcgggatcatattaaggtaaaattcataaggtgtatatcttctaataaaatactatcatttaaaaaatgctatttattccattagagatgcagtttttgcttttgttttgagacggagtctcgctctgtcacccaggctggagtgcagtggcgcgatctctgctcactgcaagctccacctcccgggttcatgccattctcctgcctcagcctccccagtagctgggactacaggcgcctgccaccacgcctggctaattttttttttctgtatttttagtagagacggggtttcaccatgttagccaggatgaagttgatctcctgatctcgtgatccgccagcctcagccgcattacaggtgtgagccaccacgcccggccaagatgaagttttctaatcctcatagtaattatgactatttcattccctctcgaaagataacaacaacaaaaaagagaacggaatgcctttttccagctgtctacatttgctttcttcaactttgaaaacaggcaagctaaagtgacctaggatggcccttacctgtctgtgatgccgcaggagtctatctggaggtccctgaaactccccagcgccccctgctgtactaagatgggatccaccgctttgtcaccaatggtgatgagccttaggcagccctgaaaccctcccagggggcttttacatccagagccagagctgttgcccaggcagcctgaatatgaagacaaaaataggacaaaagcaacaactatgacaaaactattccacagtatttactatatgaagactgctgctcccgcttgtttatggacatcggtatgatgcgatgagcttcaccattcattagagaggtgagaaggggcaaggttagaactgatcaaatttaagataatacctggaattcagaataagaaattacgggggaaaattcagatctaaaattcctataacaggaattatttcccaaccaagtgaaaagaggtttggcttcttttgtgaaatctcatctaagaaataagcatgcattttagcattatgtagtataagtgaaaaaaattaaagtggaggttaaattaaaataaatgaaatcatagcccaaattttatttaggatatgctgtgaagtgtgaaaaatgctacctgaaaatataattgtgtactaccatttatctaaaatatgttaaatatctaccctataggtgtttttgtgtgttgcgatgtatgtatatttgggagtatttaaaaacgtatttttttatactgactgggtggaaatacctagatttgcttttctagtaacactttctttggtattaggtactttagtcaaatatataactaaagattaaattctaatgttaacaacaacacaaaaagtaacaggacataacacactgttagggtacataaggataaaaatttgcagtccagaatgttctatgaatagaaagagataaaatagacatttatttccaatagtagaagttaaatattaaaagtttcactacaatcgtcagctaatttcacctaaattacaaatgacaatgcttatgacatcacttccctttactatgtgggcttgttttgtgaaacaagaacagtacttataagaagcagtggtgagtgcctgactttgacgtaagcagtattactccacaccagtccaagcatataggaaagtagtgtcttgaacttactcccaccctcttgagttacaatatataacctaataatggaactctaagtttgaaaagtaaggaaaaggatgaaagtacacactctagttaaagaaaacacaataattgtaaaatctttttatttaaagacaactgtttgtagaaagagtcatattaattcagaataaaatcataaggcatttgtctaagtcaggagtctgcaaaggttttctgtaaaacgcagatagtaaacacttttggttttgtgggtcacacctggtctctgttgcatgtccttcttgttataaccctttaaaaatacaaagcagggctgggcgcggtggctcacgcctgtaaacccagcactttgggaggccaaggcgggcggatcatgagaaccgtgaggagagattttaccctacttgcaagctaacaaatgagtctgccagtttgtttcatcgttgcggcagaagactcctgggtcaaagcaaaggactgtattacttacagcatagcaaacaatatgagcatcagcatatttgcatcaattcccttgcctccaagtcctctgggggaatatggatgggcacagatggatgtgtgcacacgcagtgggttacatgacaagtgaggagccctgagcttagggaattcaaagttttctacaggcagcaggcattgcttgccctttggcaacactgctgaaataaatctcttatagttcaagatgtattgataagcatgttaagcttatttttatacatgaagaacaacaaattgttattttctatggttattcacagtatctcaaaatctatgtgatattttactagcttagttttattataattttaaaagaccatttgggttcctttgttagtggacaagaataaaaagagataaattagttactttcttaaagctaagcaacatcattttctattgaggaacccaaaactttcctaacttttacaaatgtttgtaaattgtaggttctgtgacagcctgtgctataaaatttcataagcttataagagctttcttaacacagctgtggacttttctcctggtgttgtacagcagttcaaattagctcaagaatcataaaccctatatttgaacagctatataatattatatatttattttcccatttgatgttgcattactttttctaccaaccttcttacaataaattcataaatatcttaattatagcaaatgtgaagttcttaaagatgagaatcatcaaacatatttctattacagagatatattcttcaaaaagtcatctaaaatagaaacccaactgggagacaccttaaaagtttatctgccacaacagaagctttgcttaaaatactgttctctttgtatttgtgttaataattgatttgtctttgaaattaaattaggaatctactatatctagtggtcttgaaatcaaagccccctccccattccttatcttcactgctgtgttcaaaaagactagactccagggacgtgtccaaagctgggttaaatataggatgtctgagagacacccttctttcatagttcgagggtaagcatgtagctgtatgtgcatggaggggcgggtggaggaggttagctgtatcagggtaggcataatactatattttaaatccctccttctgttataaatgtaagctgaaaatagtctctgctcccagcggcagcaatcgtaaactcgcttagttctgcctgtaatttaatttaacatgtgacattgagacaatctttcttttaattcacatataacttcttcctcacccacattccagccaaataaacacatacttgtagaaaaatgtgactgttttcctgggcatcccaacaattcaactgtccctaaaacaccaggttcaatttaaactctattagcttgtctgagggctaagatatctaaaaatccaagacaaattatcatttgcatatatggaggcagctctgattgaacagatatctaaaacggttaggtaatattttagatcaaatcactccatcaagtcaaagactaattcaactgtttgttcagtttccaaaggaatccttccattttggtctagtgttccataaacattgactttacatgaaaaggacagtgaagagatctcttgaaccggccagaaagttgaagctcaaggttgtagaagatttgagctaccaagtccaagccttctaaaagattcccaatatgtatatatatatcattttcttaactctacatttgcctgagaaacaatgacattcaataaacttttttccatgggatttagttacaaaataagtcaaggaactacaagttatatatttcctggaaaaatatactattatacatatatattatatattcaaaactccataaagcatataaagtataagcatatactgagttataaggcataactcaacatgttattttaacctaaaattttcttaggccctcaattgcaaatgctgtaattgccaatggttcataaacacatctgtgaattagaagcaagtaatatcctctgtttttatactctcaaaaaatgtgattatacttaatcaaaagtaattcaaaccacagcccaggcaatacatactagaccatgtcttcttggtaatttaattcttagcaataattttaattgctgccttattaagtaggtatgctacttaaattacaatcctgtagttacaaggttaaaactattttaaaatctcaaatgttttcagatttcaatcactcttcgtattattacaacaaaaatgttcattaactggaacacatgcagtatcattttttagcccccactttatgatattttttaatatttattaccagagtagtcatttcattataaaattttaaccaagctaagcatatactccgttttttagaaaactagatttactgtagtcgtgttaaggctatcatagtaagcaatgaatttcacacttgtcttttatacagtaccacaacacgtcaagcagatatatgaaatccttgacaaaagacatttaaaacaaacaattccatgctttatatgtcaagtggaaaaggaatattttttctacagtgacagagcagacttgacatgtgcacaatcatgtaaaaccaagcgtttgcaaatgctcttacaacgtggagcaaccgggcctagggacaagcaacctttcagctaagagtctcgtcaaaggtgcggaagcccattacagaagaccagataacagtcagtctgacgggttcattcagatattcaagctttaaaaagtacttcgaagactgatacagatgtcctaggcaataaacgtcccaaaaagaatggggaacaatcccagtgccaattacatctttgtcattcagaaatccaggctaatttgatttagagacatacataaacgaactgttatttctcataattgttttttttcagcctctttatttttaatctacatctcttaggtaaaatgcatcaatttaactacatttacttattctgagtttttctattggtccatgtttcctttaaacacaattttgaatggttttttaaagtaaccatttgattttgaaaccaatttacagaaaacatggaagaactatgctaatatgctgtatcacccctgaatacttcaatgtacatttcctacaacaaagatgttctcctatataaccataatatgatcatcacagtcatcatggataaagttccaatatttaatccccaatcttgttcaagtttcaccaatttccaatcatgtcctttataacataagcatttaatgcagaatagtatttagttgccttgtcttcttagcctctgtcaatcattccaatgcctctttcctcactccactcaacctctgacaacttgctataggtcaccaccagtgctgtctcctgtctctccaggtccccacccttgctacactgtggatgctttccttaccctgctggtttctgaatgctctgccacggtcctgggcctccccactacccagcatggatgcctaagctgaactgaatgaccttggactgaattgttcaaaaagagaaggggagaggaagaggaagaagaatgccaagtaatttgatttttcttttttcatgaccaaaccaatgtcttggaattgattatcatttccatgggctacttatgctccgtactgtttgtgtagagtttggtgaaaatgaataaaggcaactgaactacattttttggggtttttttgttatttttttgagacagagtgtcactctgtcacccaggctggagtgcagtggcacgatctcagctcactgcctcctcacaggcacctgccaccatgccctgaaattttttcatatttttagtagagacggggtttcaccgtgttgtccaggctggtttcaaactccagacctcaagtgatccacccacctcaccctcccaaagtgctgggattacaggtgtgagccaccgcgcccggcctgaactccattttttatagagtaccatttgacactaaaattaagagtctgttactcatctgcagaatctctctttaaatggtattactaaaaggtccaaaatgaaacatctgtaaaaataattattcctacactctgtgagatctctttcctgacacatttcacatctaagtgagtttcctaactaacccacacacactctatagtaggcttacccgtctttccccaggctggctggcgaacttgcaaaacataaccatttaggggaaaaaattgaggcaattaaaattaaaagtgttttaggctaagtaatgaataaattaacccactgaaaagttacatcaaaggctattctcagcattttaccaattacaggaatttctgcaaaatctgcccagccatttgtttgtgtatccctgggatcagtgcccagagttcaatctttctcttgatgcttcctgctgttttcagggactcaatgagagcagtaagtgacctttcactcactgcaagtctatgggcactgaagttaggaaaatatttcccttcatgcagaatcttcctaacaaagctttccatgtatttgtcgggtcaaataacattcagataaactgcacataatccccacaatgccaaatgtttagagagctttttttttttttttttgagacggagttttgtgttttgctcttgttgcccaggctggagtgttatggtgggatctcggctcactgcaacctccatctcccaggttcaagcgattctcctgcctcagcctcccgagcagctggaattacagatgcctgccaccacgcccggctaatttttgtatttttagtagagacagggtttcaccatggtggccaagctggtctcgaactcctgacctcaggtgatccacccacctcggcctcccaaagtgctgggattacagacgcgagccactgtgcccggcctatagagctcttcccatgaagagccatttcatgccatcatcaacaggctgccttcgtgggtggccaacgtgcttctcgaaaaccagctgtgaataacgtgagcaactcatggtgtctacatgagaaggaaacttttagatgtccttattgactttcttcttggtattgaaggtggtataattattacagttacatagttttatctggaagaattacttgatctaaaaggtaatttaaaattagtaaaatttattagatatgaggatactaagtttcatcaacgaaagaagactgaaaacacccacagtagtagtattgaaattttacgtgtcactcagcaactcgcgagagtcccgtctggtgctgagtccatttggaatatctgtccctgccctcccctcctccaaaaagaatgttcactataaacgagaagagcttaatttctatgggctttgtaatccttccactggattccaagcaaaataactatcaatacaactaatcctgagaataaaaagtaatcacaactatgcaacaaaaacaggaaaggtggtggcagggtctcactcagatttcattgctttgcttttctccaggaaggtctttttgaagccctgtttattcaatagtaagagtgacctctagtgactttttttgttgttgtattttgccagttgattggtcaattactctagcatgcctttctataagtaactcatttatatgtttatttaagccaaacggcagtttccattacaagacccaaggattttgatttaagtaacaacgttttattcacaaaggcttctcacaaaagcagattaaagttgaatctgaaacacggtacagcatctgaccaaaggaatccggagcttgttttttggaagggcacaccaagtgtaggattaactgaggcgcaactgaatcatgatgcacagtgagttcatgaacccatgtgcgtgccctgtgtgtgaagaaccaacccacccttgagcccgcgggcagaacagcactgagctacggcaaacttttcatgacagtttaggagaactgctgaaagctacccttggttatcctgcaataatctaaatttccaaacatggccactggcgtttattggaacttatttcgaaagagattttggtaggagagggctgaggctgacagcggggagatgccactgaaagaaaaataaaagtgatttgagaaggaagaggaagacattttaaaaattctaatctcatggtttgattaatcaagaaagaaagctctctgatagagatttactccaagccaaaaaaaaatgtgcaatgttgtgtaaacatttttatgtgtgataaaatatgggtacattatgttttgctcatcggtctggaatatcatcattacattagaatcatagcccattctagaaataaaggcttcctaggtgtttaccaaattaaggaaaataaaaaacagggaacctgatggcaaattaaataatgtaaaatattagcatccagagaggaatcattttcaagattacctaaatgactggctgagttttgtctttaagcaagaactttctactatgagaaacgaagcccctgacaggggtgttcaagtgttattcccttagtagttagggcaggttattaatttagtttcgcctacaggcgctctgtccctatactgcatggaagttaattagcattttaactctgaagctgccaaggtcggcaaaactgtaagctgctaacatctaagttgatgcagtatgatgtaatgtctgccagttttttccctgttagacttaattcctacaaaatattacaatcctaaaaaggaataaatgacagcatttgcaggctaatctcttattaagatgctcttttcaggttttacagaaacgtccactttctcaatgaatattcaagtacatcgattaaaaattcaaaacatgcatggtatatcttagactcccccacaagaggaaagtctattgtaaacaaaatcgtctttttcgggttgcaattccaaatatttttttaaggtacttcatgttcaggagcatgttctgcaattccacttccaaatattaccgataataaaaaaaaaaaaaaaaaacaaagttttccagacagcctagcgcaagttttaaaccatttgctgtacttatgtggatttcctgctcccaaggggctccaagtctgagtggggagaagcagcagcaccttgaggacggcccaggccactgaagccatgctcacttcagccaggcgccctgagacccgggcacggcgacggctgctctgcgtcgctcctgctctcactcccgtcccctgcgcggctctgacgctgctctgtctcccctgtccagtctctagctctcttcctcacgcactagcagcctccctcggcgctgcagaccctcccgccaagccgcgcccggccccagctgcgtctccgaggtcggccccgcggactcgcaccgcagctttctggagcgctcggggccgcgcggcgccgccccaggcacggaggcggcaggttcaggcgcgtcccggacactaggcgcgggaggcggccggcagcaacgcgagtcaagaagcgagcgggagggacgccccagctccgcctggcgctctcctcccgttataccggcagcttcctccgtccctctctcccaccggggcggggcggccgtggtgcacggactcgctccgaagaccgcgccgtcagcctccgcctgcaggtggagaacgccaggctttatcactccgctgttcacccaacgcaggggctgcacccaggaaaatcctgtcctgtttgagttcaaatagggaagatggggcagaaataactctgcggcgtgtactcgggcagacgcgcgcacactttgattttgctaggaattctgacttgtagagaaccaagctgggaaaccgggccaggagcagggagaggccggtgagcctgggttgtgcgagtgcaagcctttatttaaagttttaatattttgtctatcatgggttttttttttctttgcgattacattcaattttaaaactatttcattcattcaggattagcgttacttaacagttgctcctgagactagtgcgttagtcccttcaccctagtcctggccttggtggatgtctaaaatttacgttttattccagctttctgtccaaaagagcaacccctgcaagtgtaggatgaggagctcagtccagcagcagctaacactgcactccttgcgcgcctgctgtgtgctagagggaggggcggaggcagggggcgggggggtctttctctttttctcttcctctgcttctcaaattcacagtaggggcaaagattgacaaactcactcacattaccaccaccgcgagtttccaaaaaagaaaaaagaaagaaagatactaacttttttagatggtatctctaagaaatagtgtattaatcttccctttggaaagacaactttgaaaggctttttcattaaaatgaattcaaatgtaatagatgtaaaatgtaaaatgtaaaatgaattcaaatgtaatagatgaagaatcttacaaagtcattcttgaattattaattgggttcacttaaactacttttgcacaagaactctgtaaatagcacgtcttttattacagaaaaaattataaatcttataaatctaaagttttgattgacagatcagttgccttcagtgagacagaaagagagaaaatggaaatcatcttctaaattggacctagagtaaaacaacaaatgtcaatctattattataccaatttgtcaggcatcagatggagtctttaaaaatgtgaacttggccgggtgcggtggctcatgcctgtaatctcagcactttgggaggccgaggaggccaagaggtcaggagatggagcccatcctggccaacacggtgaaaccctgtctctattaaaatacaaaaaattaaccgggcgtggtggtgcctgcctgtagtcccagctactcgggaggctgaggcaggagaatctcttgaacccgggaggcagaggttgcagcaagccaacattgcgccctgcactccagcttggcgacagagccagactccgtctcaagacaaaaaaaaaaaaagtgaacttgggtgttcaaagtgttaggcttaatggagaaaagccaagaaacttctacggtggtagacatttgcaattaaaacaaaatggcttcattaaactgtaaaatcactagcgtagtgagggtgcatgcattttttacaacattggaggaatatatttatgaatattattcccaatacataaaatatacattttacacacttataggtacactcaaaatttgttccaaattgttcatgtctagtaaacgtatatacactattttatatggttaagccaataagcatcagcattttcttctaagacaggaggcttgtaattgttttgattcccctgcttttgacttaaaacttatttaggtttattctacttaagttgtttggttaggggacttgaagtccttagacataaatgtgtgtcttgaaatgcattttatgtggctataattgctgctatatggttattatttaaatcagcatagacacttgctgtggtgataatgctggcaatgaactttgcagactaagagtagtgaggctctaaaaattactttgcctagtagagaagcatccgtcacaatcatcacacactacacacttactgaacaaatgaaggcatgaattcgagatggccgatgtaactagaacactggatgtcccagaaaaaatatcgaatatcacaaatataaatgttttatgggttgctgctttatttcctttcttccctactttccatgataatgcaatttaaactttgaaacttcttaccttctatttaaccttaacatggataataaatacaattatattttttatttcaatctggataatggttgtatgattcaaccagaataagaaaggaataagatctactttgcagtagcacatatttaggaagtgagtatatttatattggaacaaatgatgatactgaggtgtgtttgatgactagcttctggattataagaatgtaaatgtttgttaagacagactcttttgaaatttgttcttgaatattttgaattacaaaaggaacatttttaaaagaattgtataaagaaaatgttaataattgccactaccatcaccccaaccccactgaggtaaccaatgatacataacaggctgacaggctggtatgtatccttatgtatccttgttttggctcttcttcttcttcttttttttttttttgagacagagtctcgctctgtcgcctagactggagtgcagtagtggtgtgatcttcgctcactgcaacctctgcctcccaggttcaagcaattcttgtgcctcagcctcctgagaagctgggagaacaagtgagtgccaccacacccggctaagtttttgtatttttggtagggacaaggtttttccatgttgcccaggctggtctcgaacttcctgagctcaagtgatccacccgccttggcctcccaaagtcttgagattacaggcgtgagccatcacacccggccttggctcttatatataaacacatacaacctgtacatagagttgtgcttattttgtttcaataaggttttaccttgtactttatactctcatcctgcaattttatcgtctctctttgtagtataccgtgtgcattgcagtctaagctagaacttagttttcagttctagaaaatagagtgagaatacaaaaatataacatttgcctgccaatctaatagcattttaattcctaaatagatctactttcacaaatatgctacttctcaaagaattatttttcttatgatatttttctaagcaatgcaatgtgatattagtcagatttttaaaatgcactactgcattagtcaaggcccagaaagaaagcatgatttgctcagatagtttaaaggaacaggctgtaaagaaaagtgaagggacccaccaggtgacgttgtggcaaccaaagacaagcactagcagaaagcctttactacctacagcagaggcgcagagggaggaacggttgctgccagatccccagaaggcagcagccggggaacacaaaggtctggcaggagccacagtcatagaagtaaaagaatttcttgtcagaacctggaaacaggagtgagtagggaagaaactttttgagctctgacttctgaaaccttactgtttctgtgggtgtctctcattagccaaaaccaactggaagtcagctgggaggggagcagggtgacactcgggcaggaagggtgacactcgggcaggaagggtgacactggggctggaagggtagagggtggttctgaggacctccacaaagaatggccagcacatcctagaacactgacacttaccaaattttaaaaaaaaagtttatttttgttttgtgcattcatgttctttaatgaatgatttatcaagtaatggcttggaatagaaatctaaagctttcattttttaaattatgaaccgaagtaatcgtacttgctagaaattaaaccagagctttgagatcaaacagtttactctttcttctgtttatattaacagggaagattaattgtgccgaatatcgtagttttgaatggagctttttattaacttcaacatcaggaaatcaccagagtccacctacctttccttatttttcacagaaatagaaagattgatgttctcatagagcaaaaaagatgaggtctcacttcttgtggccttctgacatccatcaatattttaggaaaacaattctcacatttcagggccaattgagaattaagttgagctcaaatacaaagggaaatattttttattaaaactttttttgtgtgaaatgaattataaattttataaatttttttgtgaaatgaatcagctagcctaaaatttaatccttccaaactacagtaggttaaaaaaaacaagtgaatggtaaacaatttgaaattttctttccagtttcttatcactggctaattgggaagaattgaaaagtcagaagaggagaaaattataatcaatgcctactccattaaaaaattgcttaactgttttattgaaattgattctatagagagcccctgattgcatatttgataaggaacattaatgctaatacatgaaataccctatgtgctcacgtatgaaagaaacattcttggctgggtgcggtggctcatgcctgtaatcccagaactttgggaggccgaggtgggcagatcacaaggtcgggaaatcgagaccatcctggttaacatggtgaaacctcatctccactaaaaatacaaaaaattagccggatatagtagtgagtgcctgtagtcccagctacttgggaggctgaggcaggagaatcgcttgaaccccggaggcggagcttgtagtgagccgagatcacgccactgcactccagcctgggtgaaagagcaagactctgtctcaaaaaaaaaaaaaaaaaaaagaaagaaacaaagaaagcattctcccaaatattttcgtttatataaaaagataagtctcaccctaaatctatgttaaacttatagaaagaacacgtagtcacagttagaatgtgattttaggggctaggaaatcaaccccagacttcagcaaatcaatgttctaccattgaagtgtgctaatatttagtatgaaaccgcttacggatttcagatcttttcctgaaagcaaactttaatatagcagaagtcatctggatttgggctggagatggggagaatgagaggaggcaagtactataaggggtggagtgtaggggtaggagagagtaaagaaaggcattaattaaatgtcagaagtgaatttattcattttgtagttttatctaaactgaaaactgatccttgcttgaatggcttgatagagaatgcgtctctcatggggcaaggataaagctataattataaaacttcaagcttaaaataatgggactcaatgtttggggcatctttttaactcagctaatctaaggatatgagaaaatactgttcctatttacggagcaaaaattggtagatacgtgtttgggagaatttttgatttgccagcatttgtgtttcagaacactaaacagcctcttggcaagcctgaatttctgaatataatgaagcagagactgttttgtcttgagtagatccagttcgtgaaggctcaggggaacagcatgcttcatgcctgccagcagatgagcttcgaagtgccttaaggaagcactttgaccagaaggtagataactcttattatagaagaagaaggagtgtgtaattcatctcctaccggtaagaatagttattgcttttgcaaacactgtaaatgtgcaatctagaagctagaaataagtacgcagttagaaggcagtcttttttttcatatgtagtgaaactactacactttctgcagtggcaaatcttagcagagattgtaaatctaagcagagaggtatccaggattgtggtagtctacactgagtatgcctacatgatggtagagaaaaaaaaaatgaagattacatgcaggatagctccctaagaatatcagataagaacttctgcagaacaacttgttatgcaccttctggtccaaattttcaaagaaactgctgccgggtataaggatacaaaaaaagagagagagaaagggagaaaacaaacaaacaaaaatgaccctgaagtgataacatatttggctgcacttgttatttaggaaagtctgtgactcagaaatgagatggtctggagggagactttagaaacaatagcaagacacgaaagttctctcgaaaccttggatcccatttttcataataaacagaattatgtcttttttgattagcttgtgaaaattatctgagaataatttatgagaagttcccactgctataatatactgagttcaataaattattcatattttattttcattaattaaaataaacccaaatcctattaagaactttttcaaagactgataaccatgactacaaaatgctttgttgtcacatttcttttcatgccataaattaaatagacttttctttgtctctaaaggctatttaaacatattatgtttcccaggaaaggctgcagttaaatgttggcattttgtccttatgttcctatagtttcctgttgtagcagtgtagaatgaagttatgccagaataatttccacataaatattgaataaagtggacttttcatggttcaaagagttttgtgccaatatgtttcttttcttaagtgttcaatgtaaatttatgaaattgtaatattctctcataaacacctaagtgtagttgccattaaatacagattcacattcatgttagaactgctatttttttgtttcatatgatttgttctttatttttttttttttgagaaggaggcttgctttgtcacccaggctggagtgcagtggcgccatctgggctcattgcaagctctgcctcccgggttcaggccattctcctgcctcagcctgccgagtagctgggactacgggcgcccgccaccacgcccggctaagagagtgtgtgtgtgtgtgtgtgtgtgtgtgtgtgtgagagagagactacaggcgcccgccaccacgcccggctgagagtgtgtgtgtgtgtgtgtgtgtgtgtgtgtgtgtgtgtgtattttttttttgagacggagtctcgctctgtcatccaggctggagtgcagtggtgcgatctcagctcactgcaagctccgcctcccgggttcacgccattctcctgcctcagcgtccagagtagctgggactacaagcgcccaccaccgcgcccggccaatttttttttatttttagtagagacggggtttcaccgtagccaggatgctctcgatctcctgacctcgtgatccgcccacctcggcctcccaaagtgttgggattacaggcgtgagcctccacaccccgccggcaaataaattttaaagccctacattcttgggcaaattttacccttaaacaaaaattcagccaattgtactaatccaataaagagccattttagggagcctaaagtttttttatgaaagctctagttgaatcacatatcaaagtactggtctattaagtttctttttttcagatataagttaattttgatgtattttatttgctctttaaaaaatcacacttttgaggctgcgtgcagtggctcatgcctgtaatgctggcattttgggaagccaaggcaggcggatcacttgaggttaggagttcgagaccagactggccaacatggtgaaaccccttctccacaaaaaatacaaaaattagccaggcgtgttggtgcatgcctgtaatcccagctccttgggaggctagggcatgagaatcacttgaacccaggaagcaggggttgcagtgagccgagatcgcaccactgcactccagcctgggcagcagagtgagactttctcaaaaacaaacaaacaaaaagtcaccattttgaatgcttagacactactggtggacatgtaaattagttcagtcagtgtcaaaagcagtttggtgatttctcaaagaactcaaaacagaattactattctacccagtaatgagaatggtagacctaggcatgtgtatgttcattgcagcactattcacaatagcaaagacatgggatcaagctaaatgcccatcaatggtagactgaataaagaaaatgtggtgcataggcccggcgcggtggctcacgcctgtaatcccagcactctgggaggtggaggccggtggatcacgaggtcaggagatggggaccatcctggctaacacggtgaaaccccgtctcaatttaaaatacaaaaaattagccaggcgtggtggtgggcgcctgtagtcccagctactcggaaggctgaggcaggagaagggcgtgaaccccagaggcggagtttgcagtgagccgagatcgcaccactgcactccagcccgggtgacagagcaagactcccgctcgaaaaaaaaaaaaagaaagaaagaaaatgtggtgcatatacaccacagaatatactacacaaccataaaaaagaacgtgatcatgtcctttgcagcaacatggatggagctggaggccattatacgaagcaaacaaacacaggaacaggaaaccaaatgccgcatgttctcacttatgagtgggagcaaaacactgagtacatatggacacaaagaagggaacaacaggcactggggcctacttgagggtaaagggagggaagacggtgacaactgagaaactacctatctagtactgtgcttattacctgggtggcaaaataatgtgtacaccaaacccccatgatgtgtaatctacctaacaaatcagcacatgtaccccgaacctaaaataaaagttaaaaaataataacaataatcaccctttaaacctatctttcaacatttaaagtttgcaaaggcaaagttttattcacctatggaacatgttttactaactgagcaactctgggcaagtactctcttggcctcttaagtggggataataacagggcatgcctccaaatcttcctgtgaacattaagtgaatggatacgtactggacactcagaaaaatgcttgggttgtagtgatatttaagtgccattataatggcagcattgtacgaacagaaattaaaaacttcaaagtacatgtgaaaaactatttttaaaaaatctaatcattgtatgatataactagaaattttatttaagtacttaaagtaagaatatttctacttaaaattctagaagcagtgaaaaaaacattaaaaaatgaaaataaagacatttttcagacttagaaaacctgaaataattcatctccaacatagccactttacaataaatgttaaagaaagtttttaggcagaagaaaattgaaaaactgatactagatggaaatataaatgcatacaaaggactgtgggacactggacatggtaactacatgaataaaattctggaatgtttttcttattatttaagtatttttaaaatataattgtctaagtaacagtaataacaatatagcatgaggtttataacacatgtagaagtcaaatttatggcagtgatggcacaatgcctatgaggagaaaaatggaagtatgctattcaaaaattttatatgtgaagtaatatactataacttgaatatacactgtgaaaagttaaaaatatatgctacataccctaaaccaaccactaaaatatgccaacaaagagtaaaggctgataagccaatcaaagagataagatgaaattcttaaagaaattctcaattatcctttaaaaagggctaaaaaagagaaaaagtaacaaagcacagagggaacaaatgaaaaaccattttaagaaaataaacttaaatctaaccatattaataatcacattagtatcaattgcccaaaaactctaatattgacagattagattcaaagaaagcaaaagctaacagtattctgcctccaaaaaaacatactttaaatggaaaaacacaagtaaaaagacgaaaaaatatataataaacactacctcaaagaaatctggagtgactatagtagtatcacacaaagtaaatttcagttgaatgggtattactagagataaagtcatttcaaaataacaaaagggtcagtttgtcaagagaaataaaaaacctaaatgtttatataacaagtcatgtacattcaatatacatgaagcaaaatataaagattataagaaaaataaacatttttctttccacaattacagttagatttttgtttgtttgtttgttttgagactgagtttcactcttgttccccaggctggagtgcaatggtgcaatctcgcctcactgcaacctccgcctcccaggttcaagcgattctcttgcctcagcctcctgagtagctgagattacaggcacccaccaccacgcccagctaattttttgtatttttggtagagatggggtttcactatgttggccgggctggtcttgaactcccgacctcaggtgatccacctacctcagccacccaaagtgctgggattacaggcatgagccaccacgcctggcctagtcagacatttttatacccctatatcaaaaacttctacaacaagaagacaaaaattcagtaagagtgtaaaagatttgaccagcattaccacttgacctaattgacatgtatagaaaatttcaaataccaactgtcagatacacattttttttaaatgtacacagaatatttacctagaagaaaacatatgctggggcataaaattaatctcagtgatgtcagaaaaatggcagactagaaaactttagaactttgtcccccatggaaacattaaagaaaaaactacaaattggttaaactgacatttaagaactatggaaaacagctcaaggtttacagaaaacacatgaacatccaaacaaaacggagccacttccaaagcagttgaaaattgtgtggcatttttacttggctttgccacatcccatccctggaactgcacagaatggtcttaggaaagtgatagctgagcttccaattccttccctggaactggaagggtaaaccagactttatttgaaatgttctaacctgtctgggagctccatgttggattagtctctgttgtttctaactcataggtcagacagcaaagatcagaacagctcagatctcaggctatgaaaaccaatgagagacaacagacatagctcgtgaatgctgctgtgagatgcatgatagacctgcaaatgcctggagcatgagattacagatagaggaataaaatagaatattcttgactctgagaagaagcagggctatgacccctagggaaattaagacattttctaaaaggctgtatacacaaggaaaaaataaataaaagcacacacaggcccagagaaaatgaagtctgataaaagaccacagaagatgaaagccttcagaccaggctgatctaaagtcaaagaacatgcccttctaattattgaagagcttttcctacacagactcagtctgcaaacattgggagaggaaatgcctttttttctaaatgccccattttccacaataacaataacaataacaataacaataacaaattacaaggtgttcaaagagacaagaaagccatggcccaagcaaagaagaaaatacagctgcagaaactgtccctgaagaaacattgacatttgaaatactagacaaagacttttaaacaactatcttatgctcaaggatctaaagaaaaacatagacaaataactaaaaagtgaagaaaataatatatgaacaaaaggagaatatcaacaaagagacagaaattattttaaaagaaccaacaagaaattctggagatgaaaaatatggtaagtgaattgaaaaatttatgagacagctttaacagaagactttagcaggcagtggaaagaagcagcaaacaaaaaaaaagattatttaaaagtagtgagtctaaggaccaaaaaggaaaaaaaaaaaaaagaagtgaatagagtctaaggtatttaagagtcatcattgagtagtccaattattcattacagaagttccagaaacagaagagagaaagaaggaggcagtgatttatatgacaacataagtgtcagaggcgttcaaaccagagcgactccattttgagtgagggctaggaaaatgaggcagagacttgctggactgcattctcagaaaattaggcattttcctagcttctagatgtttatgaatcagtgaacaaattaatgatgcttactaaaacagacccagacttgggagtgtccagatatctcaatatctggagaataagggcattcctaattttgcattaaagataataatattgattcttgcaaaatatggtaattaagaaaattaatcctttatcaaaaactcttgtaggagagcacatctccccatatatgcaaccatcgtacctaggatggatgtgttcttcctctcactttcaggaatgtcctactctgtctatggagtagctgttctttcaccacttgcttttactttgcactgtggactcgccctgaattctttatcgtgtaagctctaagaaccctctcttggggtctgtatcgggactcctttctggtaacataaggatcaaaaatttcccaaatttttaagacatgtatatgcaaatccaagaatctcaatgaacaccaagtatgataaaacaaaaggagtgtaggcagaggaacaaaattgtcaactggaaattttataatttgcaaaactgtccttcaaacatgagaggaaaaccttctggttctaaaccagtatgtaaggagcttgatagtcatactttatcctaacaactagtaaaaagttgaacaaacaaaaaactcaacacctcttctcagatctgtcatggaaatgagatcagagagcaaaccaaggacccccaaattggagagacagacaggcagatacatagaagcaaaacttaactcatgcagaaatgatgagcagaaatctccataagacccagtgctgggttgggcatagtggctcacgcctgtaatcccagcactttgggaggccaaggtgggcagatcacctgaggtcaggagttcaagaccagcctggccaacacggtgaaaccccatctctactaaaaataccaaaattagctgggcatgttggcgggaacctgtaatcccagctattcaagaggctgaagcaggagaattgcttaaagccgggaggtggagattgcagtgaggcaagatcatgtcattgtactccagcttgtgcaacagagcaaaactccaccaaagaaaaaacaaaaaacaaaaaaacacacacaaaaaaatcaccagtgctgaagtagaaaaacctgaaactgtaattaacaaattgctggagctcaatgtgaacaactctgaaagttaaaaacttcaagtgggtacactcattgaaggtctccatacttttgtgaattatgcctccagaaactctactaggttctcagtgaatgttggaaaaaatgtcctcatgcttctggcaggaggaaggggaaaggaaccatttggaaacatgctggagtattcagttctttttcacaagacctgcaccaggagaaactattttactagggcctaatctgctggggttttatcagagcctactatatgtgacagaaggaaaatactcaactggctgtagccttccacatgcacaaaagggaataaataactccatctccttctggcctttcatgtgggggaagagaaacactcaactacaatcccttttagatttccacatggaaaaagggaaatatacaacttcgtcctcccttcagccattatgtctcatctaaagtcggggaggaactgagaagcactgatgaagttcacagtcaaggggcacagtctcaccaaaagactgagccgtaatcataggactatagaatgctccccttccccttacactctatcactacattactaaaggcctatttactatagctgcttttacttagtacattgtgttcacttttcaacaaaaaaaaattccaagatagactgaaatgcaaagaaaaaaacggtttgaaaagtatgaacaagcatcataagcagagtcaagtatggcaggaatgttggaattatcaaagcagatattttaaataattgtgattaatgtgctaaggactctagtaaacagacaacatgcaagaacagatgaattatgtaaacagagagatggggatacaaagaaaaaaatcaaaaaagaagtgctggagatcaaagacattgtaatagacataaagaagggctttgatgggctcattaatagactggacatagccagaaaagaatctttgagtttgatgatatgataatagaaatttccaaaactaaagagcaaggaaaaaaattactcagtaaaaacagaatagaatatcaaagaacagtaacaaaactacaaaaggagttaatatatatatttggaattttaaaaggacaggaaagagagaaaaaaatggaagcaatatttgaaacaataatgactgaaaattccttccaaactagtgtcagacaccaaaccagagatcaagaaagctcagagtacaccaaacaggatacatgaaaagaaaaattacacctaggcatttcatattcaacttcagaaaatcaaaaataagaaaaaaaaaagtcttgaaagaagccagagaggaaaaataccttacatataaaggagcaaaaataagaattacttcttaaattttcttagaaaccatgcaagcaagaagagtgaggttgagagaaaaaccaccagcctagatttctgcaccctgtaaaattatccttcaaaagtaataagaactaaagttcttctcagacaaataaaacctgaaggcattgttactggtagacctaccttgcaagaaatgttaacggaagttcagaaagaaaatgatgtaggtcagacactccaatctacataaataaaagaagagagtcaatgaattaataagtaaaagtaaagtaaaacattctttttttgttcttaattgatcaaagacataatagtttgttcaaaataataacagcaacaatatatggttatgtatgcatatatatatgcttttgtatacttttgtagacatgaagtgagagatagcaatgataaaagggaaaggaaggaagaattaggaatattgtgttattaatatatcttctacctgtgaagtggtatagtgtcatttgaaagtgtacttggattagttgtaaaaatatactgcgaactctaggactaatgttttaaaactttaaaaaagtataattgatatgctaagggaggagagaaaatgaaattatataaagtgctcaattaaaacacaaaaagtagaaaactatgcgcgacaaaaataactaagagcaaggacggcaaagaaaaatcattaacacagatggtacatattaattgctatatcaataatcatcttaactgtcaatggtctaaaacacaccaattaaaatacagagactgtcatagtaaatcaaaaaacaagacccagctgtctacaagaagctcattttaaatttgaagactcatagagataaaaattaaggggatggaaaagatactgaggtaaattataaagggtggtcatagcctcccttaaaggagaacaaacttgctaaatagatggagagaataaactacccgacagtgcacaaaccacatcatgggctcagggttagaacatcctgcagcaaggaggtagaaaaatagaagggagaattcacaaattcacacaagcacagaaacccatgattagtgtccttggactgacctatattcactataatagtaaaagaaaaacacccctgggtggagatttaagatgctaatgatacatgcaatgttaagtcctagcatgtacaaccacagcacctgtgcagccaggggactacccataacatactcatcagaacaccccttcccacccctccatgaataatcatgtaaatctcccataaagggcgatccccctgcatcagacagggctgtctcacctttgagcagcctgctctgatcagctgtcagagtgtacttttgctttgcaataaactcttttgcttactgttactttggactcgttctcaaatttttttgtgcagcaaagtcaagaacctgaaacagtccactggcaacagtagcatgctaacagtaattcaaagaaagcaggagtagctctattaatgacacatcccacttcagaacaagaagaattatcagaaataaagagagtaattacataataaaaatgctgtcagttctccaagaagacataacaatccttagtgtttacacacctaaaaacagagcatcactatatgttaggcaaaaactaatagaacttcaaggaaaaatagatgaatttactactgtactttgagactctaacatctctctactagtaattagcagattaagcaggcaaaaaattagggaagacatattataattcaagtcagcagtgacattaatccaattgacatgtgtagaataattcacccaacagcagaatacacatgcttctgaagctcccatggaatgttcacaaagacacatcactatctaggccattaaaaagcaacttatttaaaagcatgtaagtcatgcaaattatgctctatgactacagtgaaattaagctagaaatcaaattcagaaagatgactggaaaacattaaaatacatgaaggcgtaacatcacacttctaaataaaaaatggatcaaggaagtctcaagaggaattgtaaaatattttgaactaaatgaaaatgaaaatacaactttaaatttgaagacccatagagataaaaattaaggggatggaaaagctactgcggtaagttatagagggtggtcatagcttttcattttcgcttacatctcacgaaagtgtgtgaaatgcagtaaaacaatgcttagaccaaaattatagcattgaatgtacatgttgcatcccaaggagggtctaaaattaataatctaacttttcaccttaggaagctagtaaaggaagaacaaattagactcaaaataaggagaagaaaaatataaaaatcaataaacttgaagacagaaaaatcaatagaaaaaaatcaacaaataaaaatctgattctttgaaaagataaataaaattggtaaatctctatccagagtaagagagaaaaagaatacaaattattaatatcaacatttaaagaagaaccacctctatagatactatggacattaaaacatttaaaaaaataaagaaatattattaacaacttcataagtttgataaccgacataaaatgcagcacttctttgaaatatacaatctactaaaattcacaccaggagaaaaagacaatctgagttgtcctatatctatcaaaggaactgaatcaataattaataagctgataaaatagaaagtaccaagccccagagagttctctggtaaattctaacacttaaaagaaaaattataacaattctccagaatattttccaaaaaacagaagcatacagaatgcttccctagttattctatgaggtcattattaccatacaccaaaaccaaagacattacaagaaagaaaaaacaaagagcactatctttcattaagcaaaaatcctgaacaaagtattagcaaattggatccaataatgtgtaaaaagatgatgaagtggaccttatcctaattatgaaaggctagttcaacaattgaaaataaactgatatatttcatcacattaacaagaaaaagaaaaaaaaacaagatcacatcaccagatgcagaaaaacatttgacaaaatccaacatccattaacgataactctcggcaaattaggaatagagggaaacttcctcaaagtgacaatgtctataggaaacctacagctaacatcatattccctggtaagaagttagatgctttcctggtaagatgaaaaacaaggcaagaatgcctgctctcaccttactcaacatcatactgagggtcctagctaatgcaataaaacgtgaaacacacataaaagttaaacagatttggaagaaagaaataagactccgctcacagatggcatgactgtttatgtaaaaaatccccccaaaatcaaccaaaacatttgtggaactaacatgtggttatagtaaggttgtagaatataatgttaatgtacaaaagtcaattgatttctgatataccagcaatgggcaattggaatttgaaattaaaagcataataccatttactttagcattgaaaagagaaatgtttaggcataaattgaataaaatacgtaccaggtttatatgagaaaactacaaactctggtgaaagaaatcaaagatctaaataaatggagtataaatagaataaaatatgtacaaagtttatatgagaaaaaactacaaactgatgaaagaaatcaaagaagatctaaataaatggagagatattctatgtacatggataagaagactcaatattgtcataatgtcatttcttcaaaacttgatctgtagatttaatggaaccccaatcaaaattccagcaaattattaagtggatatccacaaactggttcaaaagtttatatgaaatgacaaaagatccagaacagccaacataatattgaaggagaagaacgaagttcgaggtctaacgaactaatttctgtatgattccaactacatggcattctggaaaatgaaaaattacagacacagtaaatagctcagtgattgccaggagtttgagggaaaggggactaggggtaaattgaacacaagagattttcagaatagtaacactgttatgtatgacacagtaattttggatacatgccattatatatttgtccaaacccatggaacgtcaatcacaaagagtgaagcctaatataaactatgggctttagtaactaatggtgtatcaatactgggtcatggattctaacaaatgtgccacactcatgtaagatgctaaaaataggagaaactgcagggaggtatacgggaactgtttttttctttcatctttttttctgtaaacctaaaacttagtaaaaactgaagcatcttattttttaaaattatctaaatacattaataaaaagtgagagattagcaaagtagatttcaaaatatcctaatcataagctgtttataagaaacctactttacatttaataaaataggtaaattgaaattaaatgcatgaaaaagacataatatgcaaatattaacaaaataatgcaggaatggctatattaatatctgatggagagacttcagagtaaggaaaattactaaagacaaagaaagatattacatatttttaaaagccaagctactatgaagacacaatgatcctaaatgtatataaaccaacagaattttaaaatacatggagcaaaatcagagaatactgaaagaagaaatagacaaatctacaattatagttggggattccaaccttctcactagctgacagaattactagtcagaaaattcgcatagatatagaaaaatatgaactacacagttcaccaacaggatccaattgatattcatatatagatttatcacataaaggaaactccaataagattaaaaactaattgctcatcataagtaatagaaggcagaagaaagtggaatgacatattaaaagtgattaaagaaaataagagaccaagaatcttatatctagcaaaactatatgctaagacttaagattaaatagacattttctggctgggcgtggtggctcactccggtaatcccagcactttgggaggcagaggtgggtggatcacaaggtcaggagatcgagaccatcctagctaacatggtgaaaccccgtctctactaaaaatagaaaaaattagccaggcgtggtggcgggtgcctgtagtcccagctactcgggaggctgaggcaggagaatggcgtgaacctgggaggcggagcttgaagtgagccaagatcgcaccactgcactccagcctgggcaacagagcaagactctgtctcgaaaaaaaaaaaaaaaaaatagacattttcatataaacaaaaattgagaaaatgtgttgctggaagatttatcttgatatttattaacactaacaaaagatttccaagctgattcctgatacgtgttcaaccccatatgagaaaacaaagaggctggtaaattgaattatgtagataattgttagagtataattggatattttgtcttctttccttaaatgatttaaaatgcaattgcataaaatgatatgtatatacacagattgttggattcgtaacctatggaaatgtaatatatttgacaataatggcacaaaggatatgagcagaagcaaatctatattggaccaaccaagaggttgacaccagatggtttttcaggtgtacaaaaataaagagaaccagaaatggcagataagaagattaatatcacaaactttacaaatgtatacttgccctcctttcttcctcagcttctttaaaagatgcaaaagtaaaaagaacaaagctggagacatcatgctacctgacttcaaagtatactataaggctacagtgaccaaaacagcatggtactggtaccaaaacagagatatagaccaatggaacagaacagaggcctcagaaataacaccacacatttacaaccatctgatctttgagaaacttgacaaaaacaagcaatgcggaaagaattgcctatttaataaatggtattgggaaaactggctggccatacgcagaaaactgaaactggaccccttccttacaccttatacaaaatttaactcacgatggattaaagacttaaacataagacctaaaaccataaaaaccctagaagaaaatctaggcaataccatccaggacataggcatgggcaaggactttatgactaaaacaccaaaagcaatggcaacaaaagccaaaatagacgaatgggatctggttaaactaaagagcttctgcacagctaaagaaactatcatcagagtgaacaggcaacctacggaatgggagaaaatttttacaatctgtccatctgacaaaaggcgaatatctagaatctacaaagaacttaaacaaatttacaagagacaaacaaccccatcaaaatgtgggcaaaggatatgaacagacacttctcaaaagaggacatttatgcagccaacaaacatatgaagaaaagctcatcatcgctggtcattagagaaaggcaaatcaaaaccacaatgagatactatctcataccagttatgtgatgcttttttgtttgtttgtttgtttttgtttttttttttttgtttttttgagacggagtctcgctgttgcccaggctggagtgcagtggcgcgatctcggctcactgcacactccgccccccggggttcacgcaattctcctgcctcagcctcccgagtagctgggactacaggcgcccgccacctcgcccggctaatttttttgtatttttagtagagacggggtttcaccgtgttagccaggatggtcttgatctcctgaccttatgatccgcccgcctcggcctcccaaagtgctgggattacaggcgtgagccacagcgcccggccatgtgatgcttttataaagcatgctttcttgcgtgccgctatgattgtaagatgtgactttgctcctccttgccttacaccgtgattgtgaggcctctctagccaggtcaaacctctttcgtttataaattacccagtcgcaagtatgtctttattagcactgtgagaacagactgatacatcagagataaagaaggacatgctgtaatgttaaagagacaatatatcaagaaggtataaaaattataaacctatgtgcactgaacgaaatttttccaaaatctacaaagcaaaaattaaaggtagaattaaaggtgaattaaaggtagaattcaacaataatagttggagatggtaatcgtagcagacatcagtatctcactttcgataatcagaaaagctaaatagatgctagcaagaatatggaggatttgagtaacagtataaactagctagatgacagtacagtacacccaaaagcagaacattactctcaagtgcacatggaacagttcctaaaatagatcacatgctaggccaaaaaccaaacctcaaaaaaagtagaaaatgattgttctttgatcaaagtggaattaaattagaaattaaaaacagaaagaactttgggaaaagcagaacttataaaaattagctacatacttctaaataaccaatgagtcagagatgagatcatgatgaaaaataaacagaagaaaggatataataaacattgaaatagaaattaaagaaatagaaaaaatggtagagcaaatcaacaaaaccaagagttgggtctttaaaaagattaacaaaattaacaaactttagctacacttacagggagaaagaaagattcaacttactaaaattaagaatgaaagagggacattactattgaccttatagaaataaaaagaactattaaaggtactatgaaaaaaagaatgtcaacatattagataatgttgacgaaatgatatcatttctagaataatatctaccaatcatttaaagaagaattagtgccattcttcacaagctcttaaaaaattttaatatttattacagtattacttataatagccaaaaagtaaaaacaaccccaatgttaattaactgatgaatggataaatacaatatggtgtatcatatatcgtatatatgatatcatgttattgaccaacaaaaggaatgaagtactaacacatgctgcaacctgggtgaaaatattatattcttgtaaatatcatgctgcataaaagaaaccagaaccaaagagtgcattttgtattattccgtttatataaaatctcccaaacaggcaagtttagacagtggttgcctaatgatgtaaggtggaggaggaatgggaagtgactgctaatgggtactgggactctttgagggtaccaaaaatgttataaaatgaaactttggtgatgattgaacaactgaatgaatatattaatatgtatgaaacattttaagtgagtaaattacacaaaatttaaattatggctaaacaaagctgtttttaaaaagtgtaccagcagcagaaaattagttataaattaatcaggattaaacagtgctcatcttgattaagcttataatggatgatgattattttacttgttttattctgtagtaaacagtttgagattcagtgattaaacaaaggactacctttacactctacttattttttaagtaaaagaaaaacattattaaaaagtgtataaactggttcatgtttatgttaactatcttacccttccttctcttttacttccaattactttggttatgtttcgggttttatttgatattgtctatggaatctgttaatcattctttaaaggaaagaggaagtgggtagggaataaagtatggagccatccaaaaacgaaaagatctgggaagatgctgtgctgatttaatgttaagaaatgttcagaaagtaaacccttgatgtcttggtttttattttagaaatattatcttgttgacaatatactaaagtgcatacaactgatttaaaataaaaataaggtatatgaaaatatgtaagatgcagctgaagcagaggtgagaggaaaatttttattactaaatgtttatattagaagtgataaagtcctcaaccaactaaattcctacctcaaacaacaaacaaaaacaagaaataaaaagagcaaaataagaccaaatcaagaagcagcatattctggtagaactttcaaattatcctttaaaaatagtcataagttcagaatctggtgtacaaattctatattatgtctccttacctttgaaatgcgttttttttttttttttttgagagacaatctcgctctgtcgccaggctggagtgcgatggcaccatctcggctcacggcaacttccgcctcccgggttcaagcaattctcctgcctcagcctacggagtagctgggactactggaacgcgccaccacatccagctaatttttgtatttttagtagagacggggtttcatcatgttggccaggatggtctccatctcctgacctcttgatccgctcgccttggcctcccaaagtgctgggattaaaggcgtgagccaccgcgcctggcctaaaatgcgtttcttttccttgatataaatgtattatctgtactactatgaatactgaaatgccataattgaggcttttttttttaactttgcaaatggaataaaggagagaaggaaggatgagagtctcctgagatatttagataaatgttagagaaaagaaaagattcaagttgatattctgataaacctgataaatcacatggacaaatctgacatttatgcgagtaaacgaaatggaaaacaatataactgggtgtaaagaaagaaggagataaaaaaatacaaagttaaatagtccctcatattggtcacaaggccaaatcagctggctcagaatgtcatttactgcagaaagcctcactgaatttcctcctttaaggaatgactttgttcctaggaaatctacactagtgtatagaaataaaggggcatactgtctgcatcttgctcttagataattcagaaaaatgtgtgtgtatatctatatcaatacctatctagaataaacaagtgtgatgatatgttaacaattgataaacctgggtaaagggtaggtatatgggagttctttgcatattttttcaacttttatgcacatgcgaaattatctgcaagtgaaaatatttgtaaaaattaaaaaacataccatttcaaaacaggctgtatttatataagaagtgcccaatgtttttgcttaatttctttgtggtaagattttagtcttccaggaaaagtttcatattggttattattgtgaaaaataatgaagtggtctgcttctaatttttctaagttcccttttgaataactaagcatctacaccaaattaaagatacttctctataatttttcaaaattcaaaaaggatgtctcataaagtaagaaaataaactgtggtttgttcctccattgttgttaatttgcaatgtcccacttatctctgatgggatatcagtaaatttacttgccttattgtacttgttccttgatgtatttctaatgattaattagaaataattacacatttgtccactttggaaagtaatggaggtgaagggggtgtgtgtgtgcacttgtatggacgcacacatgcataggtacacacacacgtattgtgttttcttgttttgttttgtgctttgatttttatttttaaattgtaaattgacaaatcatagttgtgtatatttatggagtacaaaatgatgatataatttatgaatacaatttggaataattatatcaagctaattaacatccaccacctcaaatacttgtcatttttaatggggaatgcatttgaaatttactctcttagtgatttttaaaatgtagaattctttactatgtactattttcaccaagttttgcaatatatctcaaagaaaaaaaacccttattattccttttgtataaatgaggctttgtaccttttgtccaatatctatccgttccaccccgcacctccagcctctgctaatgaccattctgctctctgcttctttcagtttgattgttttagattccacatataattgagaacatgaagtttttgtcttttttggcttcgcttatttcttttagcataacattttccaatgttgttgccaatgaaaaaatgatttttgtaaaggcatgtaattgtaacagtctcttatgatcctttgtatttttgtggtatcagttataatgtctcctttttcatttctaattttatttatttgagtcttctctccttttttcttagtctagctaaaagattattggttttatatttttaagaaacttagttttgttcatcttttgtgtcattttctagttttcatttcacttatttttgctctgatctttattattttatttccttctgctaacattggaagaatttgatatcctttttctatttccttgaggcataatactaagttgtttatttgagatctttcttctttttgctgttgatgtttattgctataaactttcctcttagaaatgcttttgctgtatctcataagtttcggtatgttgtgtttccatttttgtttttctcaagatatttttacatttcttgtttaatttcttcattgacctattggttgttcaagagcatgttgcttaattcttttaattttcatttcttcattgacctattggtggttcaccaccatgttgcttagtttccacgtattcgtacattttctggaattccttctattgttggtttctagtgtcatatcattgttgtctgaaaaggtacttgatatgattctaatattaaatttgcaaagattcgtcttgtggtctaacctgttgtctatcctgcagaatgttctatgtgtccctgagaagaatgtgtattctgctgctgttgggtgaagtttctgtatgtgtctattaggtccatttggcgtaaagcgtccttcaaggttaatgctattttctatctttttttttttttttttgagacagaatctcgctctgtcacccaggctggagtgcagtggcgcgatctcggctcactgcaagctccgcctcccgggttcacgccattctcctgcctcagcctccccagcagctgggactacagtcgcccgccgccacacctggctaatttttttgtatttttagtaaagacagggtttcaccgtgttagccaggatggtctcaatctcctgaccttgtgatccacctgcctcggcctcccaaagtgctgggattacaggtgtgagccactgccctggtctgtttagaagtatttttaaagaattattgcacttctgttcggatagaaaaacaaaaatacattttaagaatatatatgtatgaaaatataaaattttgaaaagttgaatatttcaagccaattatgtagatgtccttgtccttccctgagctgctgactcacgttccatgaagcgggatgggtctcacgggcctgtcaggatgcaggctgtgatgtgaaggccgctcagtgctcacaggattggacgggtttgtgaaggaatttggagcgagccttagttagctccttaacatttcctttgagcaacatcagtgcttttgacgttttgcactactgtataaaactgtaagtgtatgcagagatgtatgtttctgaataaatcacaaaattgacaagcaactgccatgcattgttttttgtatcatagcttactgataaagtacagactgcaacatttacttattcaaatacctttaaagatctggtatttttttgcttctacttcccaggaatttgacctcagggacattttctattatttccatatctattgaaatgaactcaaatcaaaaatgaggatgtttcattatacatttaaaatgtgagttttcccatttaaagtcacacaaactgaggttactatgaaaaagatttaaaattgtgcagaatgaatcactgaaaaattagtttattctaaagatcatatattcagagtaaatatatttaaattttattactttcagagtaaatatatttaaattttattcaatttcctctttgtcagcaaattagtgaataacattactgatatcttagatgtttgtggacacaaagagaatagaggtaaaaatcatgaccctcaaagagctcaaaatcctaagatttttatgggcagccccagaggtataaaattcaaaaggacattacttctccattcctgattaggtacgcaatgttctgggattatgcatggctctcggatccttgagagtaataatgacagtgatctctgaattaacatagttcaacttttataataattatgaccttcaaccatgtgaagtttgtggagcactgagatttcttggggcgattttgtaacagctaattcttaacagcaatgttatttcaggctttttggccattccctgttacaactgctgatcttttattcctataatggtacagaattctttgagaaaaataaattcatcttttcattcatttaaggaaaaattgtcagcacgagcctatggctataatgttctccatcatttaaagaataaaaggaataatctggttgaaattgaattatctaagcttatatatggttttgattcaatggttaacgtgcatttttaacaagtgatatggtttggctgcaacatttacttattcaaatacctttaaagatctgttttttgttttgttttgttttgttttttgcctgtacttcccaggaatttgatgtcagatgcattttctattatttccatatctattgaaatgaactcaaataaaaaaaggggatgtttcattacacacttattaatgtgtaatttaagattaatgtgtaatcttgtaattcccataatccttatgtgtcaagggtgggaccagatggacataattgaatcacaggggtggttttctccaggctgttctcgtgatagtgagttctcacaagatctgatggttttataaggggcttcttccttcactcagaactcattgtttctgctgccaccctgtgaagaggtgcctttggccatgattgtaagtttcctgaggcatccccagccatgtgaaactatgagtcaattaaacttcttttctttataaattacccagtcttgaggagttcttcataacagcatgaaaacagactaatacagtaaattggtatcacagacatagggtgctgttataaggatacactaaaatgtggaattgactttggaactgggcaacaggcagaggatggaatagtttggagggttcagaagaagacagtaaaggctgggtgtggtggctcatccctgtaatcccaggactttgggagaccgaggcaggtggatgacctgaggtcaggagtttgagaccagcctggccaacatggtgaaaccccatctctactaaaaatataaaattagctgggcatcgtgatgcatgcctgtaatcacagctacttgggaggctgaggcaggagaatggcttgaacatgggaggtggaggttgcagtgagcagagattgcaccactgcattccagcctgggcaacaagagcgaaactccatctcaaaaaaaaaaaaaaagaagacagaagaatgtgggaaagtgtggaacttcctagagacttggaggacttggaagacaagaagatgtgggaaagtttgggacttcctagagacttgaatggcttctaccaaaatgctgatagtgacatggaaaatgaagtccaggctgaggtggtctcagatggagatgaggaacttgttgggaactgggataaaggtgattcttgctacgctttagcaaagagactgcaacactttgcccctgccctggagagctgtggaagtttgaacttgagagagatgatttagggtatctcgtggaagaaatttctaagcagcaaagtgttcaagaggaagcagagcataaaagtttggaaaacttgcagcctgacaaggcgatagaaaagaaaaacccattttcttgggagaaattcaagccagctgcagaaatttgcagaacaaggagtggaatactaattaccaagacaatgagggaaatgtctccagggcaagtcagagaccttcttggcagcctctcccatcacaggcctggaaacctaggagggaaaaatggtttcatgggcccaagaccccctgttctatgcagctttgagacatggtgccctgtctcccagatgcttcagctccagccacagttaaaaggggccaaggtacagctcaggccattgcttcagagggtccaagctccaagccttggaggcttccatgtggtgttgagcctgtgggttcacagaagtcaagaattgaggtttgggaaccttcacctggatttcagaggatgtatggaaatgcctggatacccaggcagaagtttgctgcaggggcaaagccctcatggagaacctctgctaggacagtgcagaacggaaatgtggggttggagcccccacacagagtcctcactggggtactacctagtggagctgtgagaagagggtcactgtcctccagaccccagcatggtagatccactgacaactttcactgtgcccctggaaaagccacagacactcaataccagcccatgaaagcagccaggagggggttgtaccctgcaaagccacaggggtggagctgcccatggccatgggagcttacttcttgcatcagtgtgacctggatgtgagacctggaatcaaaggagaacattttggaactttaaggtttaatgactgccctattggatttcagacttgcatagggcctgtagcccctttgttttggccaatttctcccatttggaatgggtgtatttacccaatgcctgtgcctccattgtatctacaaagtaactaacttgcttttgattttacaggctcataggtggaagggacttgactcagatgaaactctggacttggacatttgggttaatgctgtaatgagctaagactctggggaactgttggaaaggtatgattgtgttttgaaatgtgaggacatgagacttggaggggggccagggacagaatgatatgatttggctctgtgtccccacccaaatcgcatcttgaattgcagttcccataatccccaagtgtaaagggtaggatcaggtgaacataattgaatcatggggtagttgcccccatgctgttctcatgatggtgggtgagttctcatgagatctgatcattttataaggggcttcccctttgctcaaaactcattatttctgctgccaccatgtgaagaggtgccttctgccatgattgtaagtttcctgaggcttccctagccatgtggaactgtgaatcaattaaacctcttttctttataattacccagtcttggatatttcttcatagcagcatgagaatggactaatacaagatgtgagtgcatttccagttaataaataggtaatattttctgtgttttctgctatggtaatgaattgcattacaacttcactaaagagagaaatcactcacaatttgagacctaaaccaagagctgaagaaagtgcaaagagacctacaataattcctataagttatttccaatggaaggcctctgtgtatgtagtactgtaatagaaaaacctatggaataaaaagaatgcattctctgagtaatgttatgcagtttaattaacccttctctgcatatttttggcagctgtcatctgtattatagggataatacaattaatggtactgtcatgattacataagtgagatgagtgaggcattttttttgttttttgtttgtttgtttgtttgttttgagacagagtcttgctctgtcgccaggttggagtgctgtggcgtgatcttggctcactgcaacctgcaactccctggttcatgggatcctgctgactcagccttctgagtaggccattgtgtgtgtgtgctgaggggttcccttattgggcaaaatgtacagggtagcaagggatttttggcagcaaaggattgtgattgggtggggaggagtagtaatatttcatgagaagtaagttgagaagcaaacgagtgctgtgtgttttcattaagcaatagggtcgacacagcatgggaacatacacatcaagtgggcggcctaacactaaatcagaagtagcctggatgagttggaagtcatggcccctgtttgtaggccaggaggatatgctttagcactggctggttttgtgggaaaacagagagaaagacatggctgagtctcagggtgctcagagaaggccacagccttggggtgccgtggtgaccacaaacacttcccccatcccataccaatctttaagagccttttcctccttaaaggcctgtcacttagcaaagagctttcaatgaaccctcccctctgggccacttgttggattgcagccaatcagtgatggagggctggacacaactgtgggatgctgtgatttggtttggctcctgggtctagagtgctctggggtccactgtacttctgggataaaacgccaaggccatgactctcttgctaatttacaaacaaaagattgagggctagctaaacaaggacagagtggaagcagctttctgtaagacacacccaccagtgtgccctgtcagtttaccattgccatggcaacactcaggcattaccacccctttcagcggcaatgacctgatgacccaaaaattaccacccttttcctaacaatttctgcacaaaccacccctgaatctgcatgtaattaaaagtaggtatacatatgactgcaaaactgggctcagccactactctcggcaccctgcctatggggcaaccctgggagcagtcactgagctgtgaccccacaggagctgtaacagtgttgctttgataaaggtgttttcttccaccttaccactggctcgcccttgaatcctttcctgggtgaagccaagaacccttgcaggctaagccccactttggggttcgcctgccctgcatcagcatcaggtttttttttttaaacttgtaaaatagtttttgtgattctgtcatgtattttgcagtcatgaactaacattttttttcctcaattgtcagttgcagtttcctcaaagatcattataaatactccttaacctacaaagtttggcagtcacagcctgctcttcgaggaacagcctgactcaccatcaagcggctcctcaggtggttttacttcccatgtttcccatgtgaggtactatgcctcagtgattcctggcaaaactaggattctctgttagtattgtgctaactttggagtgagtttcttttggtgagtaataattttagtcaatgatactactgattattttgtctttttttaggcttatgatgaatgcttgatttatgattaatatgtttttcacttttacacatttcaaggaaggaaacaagaacagacagaaacacaacatacttcatgaaaccacattttagcatcctggccgagtattcatcactcagcaagatagagagacataaactatttccagcaagaatacttcataaatgatgaatagaagaaaaaaagaagtcctaaaaatcttgcagaactgccttaatttactaatatctttacactgtatcctaagtcactctctagcttcttgctctaagcatatgaaatgtaagagctaatgggaaccccagtgcctgtataaataacaagaaccagcatgtctttatttatggcagggaacactctacaacctgggacaaatgccactctgcttcagtttggggaagctcctcactttaccatcctgacgttgaataaatgattcaaaggcaactacagatgcaacctgagccactggatgggcttttgtaaataaagttatctcacctggcattcattacagagaaaacaagaaataaggcactacatgtcatatttgtctagatcctatacctatttaggttcacattaaaatgaagagaaaacaacataggctgagaatcagaaaacctgaactctgtcccagctcagccactggccacagggaattaaccaatctctttgaacgtcagtttcttcattaagcatcgtagagaatgtcaaaaccaactttataaatactgtcattccaaaaccacacaattcaaatataaataatctttataaggtaaaacaaaaatgtacataatactttacataaacatttttagaataagtttattataactcgataagcaaaataatccaaacctttatacatttctacaaggatagtcacgtatgtcaatttttcggtttcctctcgtgcctattttgtctcctgagccggcccctttccagctgacacgtgtgctccgtgttctcccacaatagcctgacctggcctgagtccgcgcccctgtgagcctcctttctttgcttacaacagcagcctgcctgatgtcagttatggactattctttctttcagcctcatttcagggtcctctgcctcttagagctgctgctgtagcttagctagagacccgctgctgttgcatcatggaaaagtgccacatacgtgcacatgtgaaagaatacgcagaccttcatgttgtgttttagttttagaaaaagtcagaagtagcttcacttgatttcagcttgtaaagacataggagggaggcaactgagaatcaccgttgcaaaaagcaaacatcaaaaatcacattaaaatgctgaagtgttgtggagcacaaacctagctttattggatcaagcattcgtgagagttattctacttgctttgttatgctttctatcagacagggctcattctctgtcttttttttaacatattcatttttttcctttggtctgtttagattattatcacatcttatgttttaaaactagcaaaatattatgtgtaagtcatgaacacagtgtaagaaataataaaatgaacactgatgtacacattacctgcctaagaatctaaaactacccatatttttagagtccttaacactgtcctgttaattagtcccatttcttgcctttataattttgccaaaataaacgcattagtaaaggacattgaacattattgttttacatgtttttcagtttaaacaaatgggatcacactgaatatatttttctgaaattgctttttggttcaatattaaatttgtaagattcattcttatgatatgtttatctgtactttctgtgcattgatttagagtattccatcacaggataatactataatgagcattccattttattagattggggttattatccatttttttctgttacaaaaagtagatgtccttttcttgtatgagtctcctggacataagagttagattttctctaaggtataaacccaacattcaaatcattgtgtcaaaagatttgtacactaagttaaaatgaactgttttccgatttatgctcccatgagaagttaaaggttctgatagatctatattctcaacaatacctaatagtatcacagttttgttttgtttttttttttttgagacagagtctcgctctgtcacccaggctggagtacagtggcatgatctcggctcactgcaagctccgccttctggtttcacaccattctcctgcctcagcctcctaagtagctgggaccacagttgcctaccaccacgcccggctaattttttgtatttttgttagagacggggttttaccgtgttagccaggttggtctcgatctcctgactttgtgatctgcctgccttagcctcccataatgctgggattacaggcatgagccaccgtgcctggccagtatcacactttttaacattagttaacttggtttgtcattggaattttaatctgcattttttagaagtactgaatcaaggaaaaaatcaagtaatgaaaaaaatgttattttagtaaataaaaatgctataaagacaataaagcaagtgaacgtagtcaaaagcggagaggggctacttcattttgatagtcaaagatggccttgctggtcatctgagttgagaggtggctggcaagatgagaagagatgttaagtagctgtggaaggggcctgctggcacagggcatgctctaaggccctgaaaagaggcaaacattctttccctctaaatacctgaactaagtaaaaacagtcctggctttgcacatttgaatatgcacaggtttaattaacatagtttagttaaatagcactagtctcccaaaaacgtggttacaatttcagttaccacaatatgctaactgtgagcaactgcataaaatccaaacttcgttcccagctcttaattccacaaatgcctatgtgagtaaataacaggcaagcatcatgattagggactgtattaatcttgtggggatgctgcaacaaagtatgaaaagccgggttgcttaaaacaacagaaatgtattgactcgtagttgtggaggctagaagtcagaaatcaatgtgttggcaggttcacgctctctgctggctctaggggagaatccttcttcccctctccttcctgtttgggtttgccagccatccttggtgttgtctgatctacagatatatcactctgttttctctatgtgtcttcacatcatcttttttttgtgtgtgtctggagctgtatccaaattctcctttattataagacaccagttagtctattggattaagacccaccctaatgacctcattttaacttgagaacctctgtaaatgtgctatttccaaataagatcatattattttgagatattggggattaggatttcaaacatatctttttagggggacacaattcacttccttcaaagcctgtcagtgactgctcactgtgcatctgctagttcgcacacagacagcaaagtctgcaatcgtgttgattccttgtctcccagtgagaaacccatgtgacatttataaatatgaataatcagaagaaaaaactggtcaacaaccattgatgtgcagcaaagaaataaaaaatgtgataaccctggaagtgtattcaaatacaatgtaaatggaatcatagaattggcttaccacaggaaacgcagcaagaggaactcggcgcaacgcagtgttctgacataaatgaggaacgcagctgtgatgaaaaggatgaagaagccccagaggaagtgatgccggcaaagacagcaacaaacttcatattaaaggaactcttgtagatattgcatgacgttgacaatgttagatgctgttccgaaaacagcacgacagttcaccaaggcatagaaacactgctggctccttatcataagctatacgacaagagggaggcaagcactgttcaaactgggcttgatacacgtctataaataaataaagcactttaattggctgttgtttaatgttttaaattacagtgtaaaaatgaagtactcccaaccaggcacggtggctcactcctgtaatcccagcactttgggaggctgaggcggataatgaggtcaggagatcaagatcatcctggctaacacagtgaaaccctgtctgtactaaaaatagaaaaaatcagcctggtgtggtggcatgccacaactacttgggaggctgaggcagaagaatcgcttgaacccaagaagtggagcttgcagtgagccgagatcgtgccactgcactccagtctgggcgacagagtgagactccatctcaaaaaaaaaaaaaaaaaaaagtactaatttcactatgtttcatttccttatacatttataaccaacagtaagagatttttaatgttttggccaaaatttttaaatgacacagaacagttgatgtttcacatggattatttaggtcactttatagatctttagcttacatagtgatttgtatggccctgcactgctgtgcaaagagaggactgtctgtgttcttaaccagtaagaaggagggcaagaaagaggttctcagccagatattgcgtacgtaataaaatgatgggagagggaatagcactttagatatgaaatgtaccctgtggggaagctatttgaacaacaacaacaaaatagcttaatttaacccgatggagtacactcagccaccttctagatgtccctgcttattcttcaaatcttctcttttgtggccccaaagaatgattcactctctggagtgaaaaataaccgttgctttctttgcctggaactttaaactgacttgtgctgtatcatccaaacctgttcaattctctcttttctattaatcagtgaggtccaaaggagccaaagacaaatctctcctgtttttcttcgaaatgtaaagatgttgcatctgtaaccacaggctgcttttaatcctaaaagtcagcgtgataatgaaatccagtgattaatttctgtcttctaatcaataagtagacatatcaatttatagtatgttagaaaacctcaactccactgaaacaaaaagcaagaggctctgcaaatgttggagtgtgctaaaggaaaagcatggactgatgtttggggaaaggttggtcaatgtgatgaggccatctgtgtttgctaatagtgcttatcaaagttaggttcctacgcagagacagagaccaggagacaatcctgtatccttcttgatccttatagtccaaagggatagctcctaagtctttgagaaagacattctgtgttataggagatttaaagggacagagaaaaggtttataactacaggttttctgtttttttttgtgttttttttttctagacggaatctcactctgtcaccaagctagagtgtagtggggcgatctcggctcactgcaacctccacttcccaagttcaagtgattctcctgcctcagcctcccaagtagctgggactacatgtgtgtgccaccatgcccaactaatttttgtatttttagtagagacggggtttcaccatgttggccaggatggtcttgctctcttgacctcaagatccaccctcctcagcctctgaaagtgatgggatttgagccaccacgcctggccataattgcaagttttctaaagttaaggctcttagaaatgggaggtcaggggcctatagtcaagttttgggtgggacaaacagtaaattcttttggcagaattgaatgttcccaggcaggtgctttagaggggtatggggcatcgtagggacgtggctccgagctgatagaggctgtgttggaatttggccaagtcccttactgtatgtatgaggaggagggatgtgcagaagaagttgtttgtgccaagaatttgcagttttcacaggttaagacagcggtgcctgggatcatctgcaaggcatgagtcaaatgttgacacaatgattgtttgcagactcatctgagggcttaggcagatctggacctgttgatactgaagtttctgaaggtagaggaagaaaatataatgtctcaataacatctgaagtaggggtaggaaaacagagatttaaggaggtgagatcccttcaggcctcagaaagaagcttcacttcttgtgcctcccttcagaataaatgggtcattaaattagttctttgtaactaacctaggcatgatggtgaagaagggaatagtgagaggaagaactttaaataaatatgcctgagagatcatactagattaatgggagagaaagaaatttccaagaagctgtcatgggaaagggctcacgaataataatttaaaaattagttattgataatatgaataaatcaataaaaataaataaaaagagatctgccaatagccacacttacagcaccagatagattttaaataaattaaaatttgagtttttaatgaattttctacaatccaaaatttatttgtttaatttttgcaacgaaacaccatttctttactttttgcaaaagtaaaagtaagatgctacttgtactttttaaataaaactaattttaaagaaaaacataattagccagatgtggtggcaggcacctgtaatcccagctactggggaggctgaggcaggagaattgtggaggttgcagtgagcccagaaggccccactgcatccagcctgggtgacagagcgagacagtctcaagcttcttcagtactcacatgtaaacttctactttccccttcagattacagcaaccatcatgccaaagctatacactctcagggaatccctgtggatttcactgatgaccacttgaccaactatcataaagatcaaggccaggggttctcaaactctcaacatttgtgtgctcatctccccttcacccagagactccccagggctgctgggccacactttgttttgtttgactggaacatagtttgaaagggatggaaatttccaaaaggtgttaatagacacataaagatttttaaatattaaaaaaaagaaaaagaaagaaagaaggaaatgggcatttgtgaactttggtcatgagaacgcaggcctcgcagtacttaactactccttccaaacccctgcccaaagagaggaccaaactctagtgaggcttccagcagcacaaggatgtcccgcggatgaccccagccctccttaaaatgactgcctgagaaagctcacttgcaaggagaatttactgtttgtttcaggcaaaacctggtgatgggcaggtagagccccgaatcccctcttagaaccttagaaagcttgcaattataaatcttttctctgcctttgaagtgtaaatctacatcccggaattgtctcctcaaagacctgagagctgtctctttgaaatgcaaacattcaggaagctaactcttgctcttgttgccagttcctgagggaggggaaaggcctagctttggtgagcaccttgctccagcttgcacctctgactcttttattgccatcaaaatcaacatgtagacttttttcaaacccaatgacagcccattacaatggaggccatagcaatggaggtctctacatgcaaaaaaaaatggtgggacagtttcctgacaacagtccaactttattccgaggataaacatgtcatgaaattatggatggcagattatgcttgagttatctatggtcttcctttttctccttggtctcatcccaatagcttacagatcctttaaaggcaaaggccaaatattcagctaagttaggcatactttagatgccaatatcaattttagctatatgggagatcctacttaagatattgaggacgatcatgtgtgtacagggcaaaaaagatgggacaaagagataaggggatgggaaatcacaccctccctctgcaccacagaccatgacctggggcaggtcgtctaaaaccaagcccacccaggccccatctaacagtatgccgcactctacatgacctcagagttctttcggaattccagctgaaaagctgaaaagcaataccatatagctgtggtttccagctggcccatgttagtatgtatagcttttcttccttgccatgaaagcactatgggagaacgaagcccgatgctgggcatgctttgccaggtgggtgctgctgaatcacagacctcagcaactgtgttccgcctccacagaggccggggatgtttgtttccccaatgtgttcgtatatttcagccagtttcatgcactttgccctctcagtttgcttcactttctggctcggtgaacctgacctgcaagtctccctgcagtttccctcagcaagtgctcactgggcagccccaacatgtgagaaacggctgtagggtgcacagaggtgaactaaattactaaaaactattactttactaaaatgcttcctggattccaaaactcaccaactgggagaaaggtcagacacacacggagacaactcatctacacaaatgatcatcagtgatttaaagaaggtgcaggagatcatggaataagaacaagaagagattactttccagggctctcagaaagtttctgaaatgaagtgccattgaccctgaccttagcattgtgatggagacattacagagctggtaggaaggagaagaagaaggaacggctggaacacacttggggtgaaatgagcagcatttcagtgtgggagctgcagactcggttttggtggaagagttaggagccaggatcttgtcaggaataattctgtgtccaagtgcagaatcgtggtttgctccattactaccagtaactccatttctcaatcatgatggtgatgcttttttttggctctcaatcctggagattggccgtactgaagtcacattacaacaattaacttttcaactattagatgattaatttttgccaagtagcaagaacagctatttggcacgtagcagtgtggcatgagtatcttgtaaatgaattaaacaaaatatctctccagcacacacacagtcattcttgctgcatgtcagcctccacttctccctccattatttgatgccgtgaagctgaggcagccagcttgagcggaagttttcagatctcactccaacaaagagctttgattgattcacttagtataaggtgttttatctggctaaagaaatccaagctgagttttattaattactgagaaaaatatctgtgcaatagattaatctttgatcaaaactatgtgtgaagtagaaacatattacacatatggagagcaatattatggaataaaaacaacctatgtgtggcataattgacattgtctttatatttttgggggggctgaagacgcagtctcgctctgtcgccaggctggagtgcagtggcacgatcttggctcactgcaatctccgcctcctgggttcaagcgtttctcctgcctcagcctcctgagtagctgggattacaggtgcatgctgccacacccagctaatttttgtatttttagtagagacagagtttcaccatgttgtccaggatggcctcgatctcctgacctcatgatcctctcgcctcagcctcccaaactgctgagattacaggcatgaaccaccttgcctggcctataaataatttttgaaacagatacagaatatatagatagcttaacaattataaaattgtatttatcaagtatgtcacgaggtaaacattttacgctatgcaaaagggagcaaacctccgaatttgtcatgcagggtcactagtggaactcacagcaacaggtctgataaagcagaggagggaaccaggcttccgtgtgctttagagagagtgaaacatgaggagtcatagtcagagaaaactgtttttcagaaagaaaagaaaggggacatgacagcccagcagtagggtgaagagggcctctccgtgggtgccactggcttgagctgctgtaagtggctgtgcctggaacagaggatctggataggagaatggggaagggagtgctggaaccgggggtgggcaggagcagcagtctggagaccagaatgacctagggtttcctctcatgctcccattcccagtgtttcacgtgtgtaaagtagcaagcatgcatatactgcttagaggcatctacacttacatactacactcatatccaacacttgcatcatacaaagtacacatagtaggtgtggcatgtaataagttaccctcttatattttcttctaaaagatttttaaatatttgcatctcaaatttaagtcctttgtccatttagatctggcctttgtgtgatagggatccatttttgtgatagagatgcattctgatattttcccatatggataccaattgctcataccatggactatatagaccctttctgactgttctgtaatgttagccaggacatacatcaagatttcacacaagcatacactttcacaatagcaatatctgctgtggtaattataacttcacagcaaatctggtacgagatagactcacataagctccacctcccaccttcgcacactttagtcttctatgggattgtcttagttatactgggcccttttctcttccatataagctttggaagcagtttagtgacaatggtactcttgtctttttcttgattttaaaaggagtgatttcaatatttttaatcacaaaacatgataggtgctgtaggttatttgtcgactccttttatcaggttaaggaagttaccctttattcataggtggaaatatcaataatttaatttttgtaaatttttttttttttttttttttgagagggattctcactttgtggcccaggctggagtgcagtggcgggatctcggctcactgcaagctccgcctcccggattcacacctttcttctggctcagcctcccgagtagctgggactacaggcgcccgcctccatgtccagctaatttttttttttttttagtagagacagggtttcattgtgttagccaggatggtctcaatctcctgacctcgtgatccacccgcctcagcctcccaaagtgctgggattacagacgtgagccactgtgcccagctgtaaaataattttataggccttttgagacaatcatataatttttgtctttaatttgttgataaggagataatttcagtagattttctaacactgaactaaatttgcattactaaccgagcttgttcatggtttttatactttgctaggtatacttcctagtattttgtttacactatttgtctgtgtgcatggatgaggtacaccatagcaaggttatcctagtatcatatgaattaaagaatggtctcttttttttcccctcgcagattattagtgtaacattggaactactggtgacatcatctgggcatcatgttttctttgtagaattattaattattaactcaattactttaatggtatgatttccatctagattttctaattatttgagtcaactttgataaattatatgtatccaaaaatgtgttaatctcacttatttacaaatgcatatatatgtcttgttaatgaaatagatcataaatataaaagtgtgtgtgtacagcttaagaagaatataaaatgagcatatgcgcccttccttcaggttatgaaatagaatatttccagtatcttagaaactcccattgcccttcttcaatgccactcactctttccacaagaggtaaccactatccctaacttcctgttaatcattccattgcttgtcattatagacttgcatattgtttagttttgcacatgtttgacttttttaataagtgaaactgtgtattgtttcttgttttttttttctgagacggagtctccctctgttgcccaggctggagtgcagtggcgtgatctccgcttactgcaagctccgcctcccgggttcatgccattctcctgcctcagcctcccgagtagctgggactacaggtgcccaccaccacgcctggctaattttttatattttttttagtagagatggggtttcaccgtgttagccaggatggtctcgatctcctgacctcatgatctgcccacctcggcctcccaaagtgctgggattacgggcgtgagccaccgtgcctggccaactatgtattgtttcttgtgattagatatgcatacacacaaacatgtgtatgcatatatatatatacatgtacacacacattattttttagagcagtttaaagttcacagcaaaactgagcagaaggtatagatttcccatatactccctgccccccacacatgcatagcttctctcatgataaacgccccccaccagagtgctgcatttgttacaattaatgatacatgatacatcttatagtttgcattaaggttcacactcgggcttggacaaatttacaatgacaagtattcactattaaaatatcatacatgtactttcagggccctacacatcctctgtgctctagttattcattcctctcttcctcctaactcctggaaaccactgatttttttttttttctatctctatagttttaccttttccagaaaggtcatatagttgtaagtgacagtatgtagccgttttagattggcttctttcactttgtaatatgcatataagcgtcctctgtgtcttttcgtggcttgacagctctttttattttttattttatttattttttttatattttttttttagagggagtcttgctctgtcgcccaggctggagggcagtggcgtgatctccactcactgcaagccaagctccacctcccgggttcacgccattctcctgcctcagcctcccgtgtagctgggactacaggcacctgccactgcacctggctaagtttttgtatttttagtagcgacggggtttcaccgtggtagccaggatggtctctatgtgctgacctcgtgatctgcctgcctcggcctcccaaagtgctgggattacaagcgtgagccatcgcacccggccaacatctcatttattttatcattgaatgatattcaattgtctggatgtaccacagtttgttaattcacctactgaaggaaatcttgcttgtctccaagtttttgcaattataaataaagcttccataaacatctgtgtgcaggtttctgtgtggacataagttttcaactcctttggatatataccaagaagcaagattgctgggtcgtataataagagtagatttagttttctaagaagccacaaaactgttctccattttgtatttctatcagcactgaatgagagctcctgttgcttcacatcctcatcagcatttggtgttgtcagggttctggatttttgccattctaatacgcatgcagtagtatctcattgcagtgctgtatttgagaatgtgaatagctgcagttcattcactcttagtgctgcgaggtactctattatcggaatatatgatcatttagttacccagtccactatctacccatattgagagataactagattgtttccaggtttttaaaattgggaacattctcatacacctctaggtaaacaaacgcaagaatttttctggggcctgtaacaggctgactaggttgcactaggttgtagtgaagtcactgggtcatagggtacgttatgatcagctgtatgagccagcatctgtctgttttccaaatggctgtcctactttagtgtgtgggatgaatacttccgtggttctttatccttgccaataccacacgtttcggaacttcaaaaaaaaaattgtcaatatgtatgaaaggatatctaattgttaattttcattttcatgattattatgaggttgagcactttttacatgcttatggggtatttgtgctaacttctcaacagacatgttatttttcacttatttataggaggcatattctggataccagacctttctaggtaagatgtgttgcaaatagctccgccaagttttgggtattttttttcacattgcagtatcctttaataaacagaagtattaaatttttgtgttatcaaatcaatttttcctctttcagtttgttcttcttccccatgtaaagataaaagatatggccaggcgcggtggctcacgcctgtaatctcagcactttgggaggccgaggtgggcagatcacaaggtcaggagatcgagaccatcctggctaccacggtgaaaccctgtctctactaaaaatacaaaaaattagtccaggcggggtggcgggcgcctgtagtcccagctactccggaggctcaagcaggagaatggcaggaacatgggagaggagatggagcttgcagtgagccgagaccgcgccactgcactccagcctgggcaacagagcgactccatctcaaaaaagaaaaaaataattattcccaggtttttttctaaaaatgttgagaagctatctttatccgttaaaatatatttttatgtttgttctccgggattaagtttcaatttcatttttttcccttatggagatcagtggtcccagtgttgcttattgtaaaatatactatcttcacttaacaacaatgaaagctgtgttacaaaatctgtttcccagtattagtgcaaaatatatttctctttatgattgtactcagattaactagtttgcaggactgtgtccagagttggttccttcggtgggttcgtggtctccctgacttcaagaatgcagctgtggacctttctggtgagtgttacagttcttaaagatggcacggaaccaaaaagtgagcctaggaaggtttattgctgagagcgaaagaacaaaacttccacaccctggaaggtgaccccacctggttgctgctgctggttgcgggtggccagcttttatccccttatttcttcccacccatgttgcgtttctgtcttatcagagtgcccttttttcaatcctctccactattgactacttttagaatcctgctgattggtgtgttttacagaggctgattggtgcattttacaaattccttgtaggacaggaaagttccccaagtccgcactcgacccaggaagtgcagctggcctaacctctcactgccagaggctaatttccatcctggtatttctcaggcccatagatagtgtgaattcaaatccaaacccatatgtctattgacttagacatacttagaaattaccattttttttttcttttttcttgtctaccctattgaaaccaagacaagcatagattttcactttcttcttatgggagtgggattttcctagccccacttaacatgcttctttttagaaatcctagatttatgcagaaggcattttagcctatattcctccctgcatgggcatcagtctctgtctcctgaattaggtgctcatggttctgggccaatagttcctgggagacaccccagggcaaatgccagatgagacactcacacctctggattcaaattttttttgctcttgtagatatctgaaaatttgccttactttgactcagcccatgcattaaagcagatgcttttaaatattttatgatgcatgttttaggaaagagtctgtctgggtatttcttcttttgatttgcattttgctttcaattcttctttcacactatcctaagcattaatcaacttgtcgtttatgtcagttagtacaaaacttcactatcctgttcattatcaccatttcattttgttctgcataggccagactatttatctaaaaatgtttaaagaaatctaaggccttaaaggattctttctcagggactctactgtttgtatttagagaaatgctcatttgttccactgttttactttcttcttgggtcacgctctttgatgactgccatcttacagaggatgacaaaagagggcccaggctgagacaatgatacctgcttgcccctttggattttattttcttagtgttctcaaaatattaataaaatgtcaaaaacaaattaatatcaccagaatgtgtgcctcacttaaaatttctctctctaacaagtttttgtttcctagttcctttggtaccctaatgtttaggtaaatagtctctgaggaaaggatgtgaaagtcatagcaaaatatatgctggacttgaatgaaaaatatctgtttcataaaagttaagcaggcaaccaaaatttaccttttttaacctaaattatctaaacatgtatttacatttctgcttcattaaaatatatttgagattgaatgctcctgagacagattttggaatgccctccctttctaaaatatattttttattttttgtggactaaacagttatttaaaaatgaacttaatgattgctaattagttatctaaatacttatttaaaaataaacttaatgattgctaattactcagttatttataatgcatttcaaaattaactttattgtctaaacctcttaacacaaatgtattaaattatgtaacagagaattggctatttttgttcaaatatctattcttgtcagacttaaaatatcactcagctatatgattaaaaatgaactacagtcattaaattatttcccacttatttgtggcatttctccatattagaggagacaaacagtgctctttgaatcttttttttttttttgagacggagtctcgctctgtcgcccaggccggactgcggactgcagtggcgcaatctcggctcactgcaagctccgcttcccgggttcacgccattctcctgcctcagcctcccgactagctgggactacaggcgcccgccaccgcgcccggctaattttttgtatttttagtagagacggggtttcaccttgttagacaggatggtctcgatctcctgacctcatgattcacccgcctcggcctcccaaagtgctgggattacaggcgtgagccaccgcgcccggcccagtgctctttgaatcggatgacagttctattgataatggccatcacaatctagttacgcattattaattaggtcaaggcatgaataaaatttctcccttgtttccactcaaaaactacaagtatagttctttggtaagatgctccaaccatggctgggtgcggtggctcaagcctgtaatcccagcactttgggaggctgaggcgggcagatcacgaagtcaggagattgagactatcctggctaacacggtgaaattctgtctctactaaaaaatacaaacaattagctgggcatggtggtgtgcacatgtagtgccagctactcgggaggctgaggcaggagaatggtgagaacctgggaggtggagcttgcagtcagccgagatcacgccactgcactccagcctgggcaacacagtgagactccgtctcaaaataaataaataaaataaaataaaaaataaaataaaaaaaagatgctccaaccatgattggtgatgccaatcatagaagaaaagagaatattgagaaataataagacagctactttaaaccattctgtgcctgaacattttgatggcaatattggtcatattataaatttgaaaatataaatggtaatctaaattgactttagtctaccagtgattatgagagctttatctaagtgaaacacttgcatttttatttccaacatttttcagaaaatgtgaaactccgaccaagtgcagtggctcatgcctgtaatcccagctcgttgggaggccgaggcaggtggatcacaaggtcaagagatcgagaccatcctgtccaatctggtgaaaccccgtctctactaaaaatacaaaaattagctgggcgtggtgatgcgcacatgtagtcccagctactcgggaggctgaggcaggagaatcgcttgaacccgggaggtgaaggttgcagtgagccaagattgtgccactgcactccagcctgggcgacagagcaagactccatctcaaaaaaaaaaaaaaaaaaaagaagaaaaagaaaatgtgaagctccttattattttgttttaattttaagaattccacttcctagataagcagaacatacagccaagtgctatgttctggttgtttttaatgagtatatttatgttctccccaatttattatttattaatgtctaacttcaattagatgagttgattacttttcatacaccattgactaaaggaaacctaattttacacgtaattcaaggggatctgtaagtaagaacattttaaaattaaaccaacacatgtgcattgaaaatcattcaaacagtttgatgggcaaaaaaccagtgaaaaccagaaactttttttttccttccatagaccttggtcctgtttttcagagttaggcaaggtttatcattttctttttttactatatgctattctcttgaactgtaaataatattatacaatcacctaattttgttttaacaattttaagtaatatcccttgactttttataaacggtagagaatatagctcatttaccctactttcttcttctaaaactatatttccaatttagtctttaatatataattttatgggatttttaaaaaatttgctttctctaaataatatacttacagtgcttaattctttgcttaaataatatactgtttagataatatatggtccatccaatttgaacaccactgattggctcagtaggatgtggagattagtgtacaacttccctcccctccaacagtccctgtcatagctttcgacttgtatcaaatttcattctatgcttatattttcacattttatgtaaattacatcctattttgtaattataataaagtctgtgctttgttcgtaggttaattttgatcatggaatctcaagtgaattgacagcatcattattatgttttctttttttttcaaaccacagtcgcaggtggcgtgatttgatttgtgtgaaggcaatgaaatgatacacagatacaccgaagcctcccaaaagaatcctggttccaagactcaagaagatggattaatgtttttccattaattgttggaatttatgccattttttactatgtgccatcaattttaaagcacttctgaaaagacataacaatctaaatgagatggcattttaaattcataaaaatatagtattttcctcaacttttatacatttatgatgcattatttcttatttcccgggaattttactacctttgttttgaatgattaaaaaggaaacacagcacttttttcagcacatcaccaagatagcctagttaatattcttctctttctgaagtagttgaattgggatagacagcttgccaggcctgctgccacgtgtcagcatcgcatccctacattcagccacacttgcatctaacgaccatctctttcattaaatttcttttgcaccttttcttcctgaatgagtgcatgatacttaattttcctgtgcacttgcatgtctcaagaaggttttaattctttttgtattgcattaatattaagttaagtttataattgcaaaatgatttatactcagaacattgaagactcctttgttttgttacatcctgtcaaaatgatgagaagacagatcatcctttagggaaaaattggttttgattggtgtcagcctttccaacagcaatgctggagacaagaataaaatgaagtaatatttttcaaggattaaaaggaaaccaattttaatccttgaattatttgcagccacaatcttttaaatatgaaagcccagaaaaagacattaaaaagtaaggcctcaaaagttttatttcaaataaatccctttgaaaatgcttagaggtcatactccactaagaagagaaatacaccgtggtgttagaattgagggttccagaatcaatggtagtggtgtttatcatactctaaaaaataaatgaaaacataacatattgaaaacaaccccgagtaaacttcagaaagcacccccttagacaaagtgctgtcgtaacagagaaagcaaaccagaggtggcaagaggaagctagagcacttatcttgtttgctgagatgatattaattttgacacatatcagaaattgagaaaattaacataaataatgatataaccaccattacaatgttaaaaatttccagatttcaaacaaatagaaaaagatttgatctatacagtgaaaggtacaataggaaaaaataaacagtaaagaaagtatgaaaaatcataaaatgagatgacagaaataactcataatggaacaataattacataaatcaaaggttaagattgtcaggtaaaatttttaagtgtcaaaaaaacactcaataaaacctatcgaaaataaattagtgtaaaaaatatagcaggaaaatatgaataaaaagagctaggtccaatttttgataaaaatttgaattcaagttaataatatcctaaagaaggaaaaaatctgtagaccaatagagagaaaggaaaggcgcattcagacaaagaaaatgtgtacagaacacactagggatatcagaagaggctgctcatggccaggcatggtggctcatacctgtaatcccagcactatgggaggccaaggtgggtggatcacctgagctcaggagttcaggaccagcctgggcagcaagggaaaccccatctctaccaaaaatacaaaaaaattcgctagccatagtggcacatgcctgtggttcccgttacatgggaggctgaggtgagaggattgcttgagcccgggaggtggaggttacagagagcccagattttgccactgcactccagcctgggcaagaatgtgagacccagtctcaaagcaaaacaaaacaaaataaaaaagaagctgctcaagaccagactgagctcctagaccttgaactccagtcccacctcacaccctaaggttcctaaagaatcagtaacttagttcaccctaccgcactcctgacttctggatgtagcacaagtttctaaacttatgcaaacagtgaggactatctattttgacaaaataagaaatggagtcaaggcaacatgtaaaagatatttttgccagttttattgattaacaaagaaaaattgtatatagttaaggtatgcagtgtgatattttgatatacatatacattgtgaagtgatgattaccacaatcaagctaacatattcatcacctcacctggctacctttttatttgtgtttgtgtggtggagaacacttgagatctactctttcagcaaatttcaagtatacattattattgactttagtcactatgctgtacattagatctccagaacttattcatcttataactgaaagtttgtactttctgacaaacattttttcttttcccccaactcccaggccctagtaagcactattttactctcttaccatgagtttgacattttcttagtatgcatataagtgaaatcatgcaggatttttttgcatctgttcctggcttattttacttaccataataaactccaggtttatccatctcgttacaaatggcagtatttcctcatttttaaaggctaaatgatattccattacatatgtgtgtgtgtctgtgtgtgtgtgtgtgtgtaatacatttaaaacatccattcatctgtcaatggacacaggtagtttccataccttggctgtgtaaataacactgtaataaacatgtaagtatatatatctctctgagatagtgattttctttactttggatatatacccagatgtgagattgctggattatatgggagttccatttttaattttttgaggaaactacatactgttgtctgtaatggctgtaccaatttacattcccatcaactatcaactaagcacaagggtttctgtttctcaatatcctcagcaacatttgttacctttttactgttataaaagccatcctaatagatgcgaggtgatatctcattgtgcattttcctgctgattagtgatggcaaacatctttttcttaatatatacctattgtcaatcgtatgtcctttagaaatgtatctcttcaggtctgatatgctttggctgcatccccacccaaatcgcatgttgaattgtagctcccataattcccatgtgttatgggagggacccagtaggagatagttgaatcatgggagcggttttccccatactgtttttgtggtagtaaataagcctcacaagatccgattgttttataagggatttcctttttcacttggctttcattctgtcttgcctgctgctgtgtaatatgtgcctttagcctcccaccataagtaaggcctccccagcctcatggaactgtgagtccattaaacctctttttctttataaatcacacagtctttggtatgcctttatcagcagcatgcaaacagatgaatacagtaaattggtactggtagagtggggtgctgctgtaaagttatccaaaaatgtggaaccaacttcggaactgggtaacaggcaggggttggaacagtttggagggctcagaaaaagacagaaaaatgtgaaaaagtttggaactccctagagatttgttgactagctttgaccaaaatgctaataatgatatggacaatgaaattcaggctgaggttgtctcagatagtgatgaggaacttgttgggaactggagtcaaggaaaatcttgctatgttttagcaaagagactggcagcattttgctcctgccctggagatgtgtggaactttgaacttgagggagatgatttagggtagctggcagaataaatttctaagcagcaaagcactcaagaggtgacttgggtgctgttaaaagcattcagttttaaaaggaaacagcataaaactttggaaaatttgcagccaaatgatgtgatagaaaagaaaaacgaattttctgaggagaaattcaagccggctgcagaaatttgcataagcaacaaggacccaaatgttcatcaccaagacaatggggaaaatatctccaggacatgtcagagacctttgcagcagtccctcccattacaggccaagaggcctaaaaggaaaaaatggtttcctgggctggtttcaggggccccctgctgtttgccacctagtgacttgatgccctgcatcccagctactgtagccatggctaaaagggtccaaggtacagcttggactgtggattcaggtggtgcaagccccaaaccttggcagtttcacatggtgctgagcctgtgggtgcacagaagtcaagaattgaggtttgggaatctctgcctagatttcagaggatgtatggaaactcctagatgtccagaaagaattttgctgcagaggtggtgccctaatggaaaacctctgctaggacagtgcagaagggaaatatggggttgaagcccccacacagagtccccactgaggtactgcctactggagctgtgagaagaaggccactgtcctccggaccccagaatggtacagccaccaaaagcttgatcatgcacacaggaaggctacagacaatgccagtccatgaaagcaaccaagaggggggctatgtcctgcaaagccacaggggtggagctgcccaaggccatgggagcccacctcttgcataagtgtgacctggatgtgagacatggagtcaaaggagttcattttggagctttaagatttgacaggcctgctggactttggacttggggcctgtagcccctttgttttggccaaattcacccatttggaacaggtatgtttacctgctccctatacctccattgtatctggaaagtaactaacttgcttttaactttatgagttcatagctggaagggacttgccttgtctcagataagactttggactgtggacttttgagttaatactgaaattagttaagatgttgagggactgttgggaaggcataatttgttttcaaatgtgaagacatgaaatttgggaggagctggggcagaatgatatgattcggctgtgtccctacccaaatctcctcttgaattgtagttcccataattcccacatgttgtgggagggacctggtggaagacaattgaatcatgggggcagtttctcccatactgttcccgtggtagtaaataagtctcatgagatctgattgctttataacgggtttccccttttgcttggctttcatcctgtcttgctggctgtcatgtaagacatgactttcaccttccactgtgattgtgaggcctccccagctacgtggaactgtgaatccattaaacctctttttttttttggagatggagtctggctctgtcacccaggctggagtgcagtggcgcgatctctgctcactgcaagctccacctccaaggttcacgccattcttctgcctcagcctcccaagtagctgggactacaggcacccaccaccacacctggctaattttttgtatttttaatagagacaggatttcaccatgttagccaggatgatctcaatctcctgacctcatgatctgcctgcctcggcctcccaaagtgctgggattacaggcgtgagccaccgtgtctggccaaacctttttctttataaattacccagtctctggtatgtctttatcagcatcatgaaaacagactaatacaagatcctttggaattgtctgagttcctaatttatttggatattaacttcttatcagatgtatagtgtgtaaatattttctcccattctttaggttatcttttcattgtattggttgtctcctttgctgtgctgaagcttttagtttgatttactcccatttgtctatttttgcttttgttgtctatacttttggtatcaaatctgaaaatttattaccaataccagtatcaaggagcttttctctgatatttatatctaagagtcttacaatattggtcctatgttgaggtctttcatccattttgagacaatttttgtatgtacagtgagataagggttcagtttcattcttctgcatgtggatatccagttttcccaacaccatttaataaagagactaaattttatcattgtgtactcttggcaccaatgctagagatcaattgattgtaaagtcatggatttatttctttctatgctctctattctgttcccttggcctacatgtctgtttttatgccagtagcatactattttgattactatagctttataatttagtttggaataaggtaatgtgatgcttccacttttgttttttctgctgaaggatgttttgactggggtcatttgaggttgcataaaaattttacaactgcttttttccatttctttgaaaaatgtcattgaaattttgatggggttgcattatatctatagatcgcgctgagtaatagggatatgtatcttcttcaaattctttcatcagtgttttatagtttttggtatatacaaattttactgtcttatttaaatttcttcctaagtagttaattttttgatggtattgtaaatgagattgtgttctttcagacggactctcactctgtcgcccaggctggagtgcagtggtgtgatcttggctcactgcaagctctgcctcccgggttcacgccaatctcctgcctcagcctcccgccaccacgcccagctaattttttctatttttagtagagacagggtttctccgtgttagccaagatggtctcgatctcttgaccttgtgatctgcccacctcagactcccaaagtgctgggattacaggcgtgagccactgtgcccggcccgagattgttttgttaatttctttctgggatactcaactattagtatataaaaacgtaacaggttttttttaatgttaattatgtgttctgcaaatttgcttgtttcttaattttaacagtttttaattggagcctttagaattttctctatatgagatcatgtcatcttcaaatagagacactttcacttcttttccagtttggatgccttttatttctttttcttacctaattgctctggctaggacttacagactttttcagaaaccccccaaaataatctaagggagtccattgtcactagacctgctttataagaaattctaaagggagttcttcaaactgaaatgcaataagactaattagcatcacaaaaacatatgtagttataaaaagtcaccagtaaaagtaactatacagtcaaattcaaaatattcctaatactgtaatgatggagtataatcactttaacttttaaaaggttaaaagacaaaaaatattacaaataaatataactacaaaataaacaaagaaataaacgctgacatcaaaaaaacataaaaactggaggggagtaaagtgtagggttttgtatatgcttgaagttaagttgttatcaacttaaaatagaccattataactataatcatacatttcttaatgtggatatgttctgaataatgcctcattatgcaattttgtcatggtgtgaatatcatagagtatacttacacaaaattagataataccacctactacacacccaggctatatggtataacctattgcttccaagctacaaatctgtacagcattgtactatactgaatgctataggcaactataatacaatgataagcatttgtgtatccagatgtatctaaacatataaaagatacaataaaaatgttataaccttatagggccaccgttgtatatgtggcccatcattgaccaaaacatccttatgtggcacatgagagcatatgatgttttatggaagcctcaggataatcacaaagacaaaacatgtaatagttacacaaatgagaattttaccatatgtttaaaaaagaattaatacaaagacacagaaaagaatcaaagtataccactacagaaaataatcaaaataatcaaatcatgcacagcaagagagaaataaaagaacaaagaaactgcaaaatgcctatcaatagttactttaaatgtcagtggaccaaattagaaaagacacagagtggctgaatggacagtaaaacaataaccaaatatatgccacctataagagattcacttcacctttagagacacacatagactgaaaggaaagacagggaacaaaaaaaaagaaagagtagctattcttacaacaaacaaaatagactttaagtcaaaaactgtaacaagagggaaagaaagtcattatagaatgatacaagggtcaattcatcaagaggatataattactacaaatatatattctcccaacattggaacacctaattgtataaagcaaatattaacaaatctgaagagagaagtgacaacaataatacaataacagttggggacttccataacccactttcaacaatggattgatcactcagacagataatcaataaggaaacagatgacttgaactacactatagatcaaatggaccagacatatacaggacattactttccaaaacagcaaaatacacattattcttgagcatacacagtacattctcctacacaggtcatatattgggccagaaaacaagtcttagcaaatttaagaagattgaaatcttatcaagtattctttttgaccacagtggcatgaaactgaaaattaaaaacagaagaaaacttagaaaagtgacaaatatgtggaaatcaaccaacacactcctgaacaaccaatagatcaaagaaaacatcaaaaaagaaataaaatatcttgagacaaactaaaatgaaagcacaacatactaaaacttatgagatgaagcaaaagcaattctaacagggaagtttatacaggttaagtgctaaatgaagaaaaaagatctcaaataaacaataaacctcaaagaaatagaaaagaaaaaaaaaatgaagcccaaaattagaagaaggaaggaaataacaaagatgatagcagaagtaaatgaaatacactagaaaaacaatagaaaagatcaatgaaacaaaaagctgattttttgaaaacataggccgggcgcggtggctcacgcctgtaatcccagcactttgggaggccgaggcgggcggatcacgaggtcaggagatcgagaccatcccggctaaaacggtgaaaccccgtctctactaaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaacataatggctgggcgcggtggctcatgcctgtaatcccagcactttgggaggcgggcagatcacgaggtcagagatcaagaccatcctggctaacatggtgaaaccccgcctctactaaatatacaaaaaattagcagagccgggcagcgtgcgcctgtagtcccagctacttgggaggctgaggcaggggaatggcatgaacccaggaggcagagcttgcagtgagcggagattgcgccactgcactacagcctgggagacagagccagactgagtctcaaaaaaataaaataaaataaaataaaaataataaaaattgaccaacctttcactaggctaagaaaaaagagagaagcctcaaataaataaaattagaacaaaaaagcagatattaaaattggtaccatagaaacacaaaggataataacagtctaaacaactatgtgtcaacaaattgtttaacttagaagaaatagagaaatttctagaaacatacatcccctaagattgaaacatgaagaaatagaaaatcaacacaaataatgagtaaaaataatgagtcagtggtcaaaaagctcctgaaaaaggaaaatccaagaccagatagcttagtggagaagtctagcaaatgtttaaagaagaattagtaccatttcttcacaaactcttccaaaagttgaagaggagggaatacaaacattttttatgaggccagcattaccctgataacaaagacagaaaaggatactacaaggttgacagatatttttaaggtgcaaatgatgtattgttggaattgaaaatacaggatttgtttgtacaaagatttgtgtgtggataggtggatgcgtactggtgtgtgcatgcatacatatacaagcttaccttgttttattgcacttcactttattatgcttctcggatattgcattttttacaggttgaaggtttatggcaaccctgcatcaagcaagtctaccagtgccacttttctggtagcatgtgcttattttgtatctctgtgttacatttttgtaattcttgcaatatttcaaatgttttgttattattatatctgttacggtaatctgtgatcagtgattattaatattactattgtcattgttttggggcatcacaaaccatgctccaaaagacaatgagcctaattgatacatatgtgtgtctgaatggttccattgatctgcccttcctccatccccccaactcctcaggtctccctgttttctgagacacaggaatattgaaattaggccaattaataactctacaaaggcctctatgtgttcaagtgaaagtaagagtcacacatctcttatttaaatcaaaagtgagaaatgattaaggtgagtgaggaaggcatgttaaaagctgaaacaggccaaaaactaggcatcctgcacctaacagccaaactgtgcatgaaaagaaaaagttcttgaaggaaattaaaagtattactccaatgaacacatgagtggtatgaaagtgaaagagacttatcgctgatatggagaaggtttgagtggtttggatagaagatcaaaccaaccacaacatttccttaagccaaaccctaatcgagagcaaggacctaattcttcttaattctctgaaggctgagagaggttgggaagccacagaaaaaaagtttgaagctagcagagattggttcatgaggtttaaggaaagaagtcttctccataagataaaagtgcaaggaaaagcagcaagtgctgatgtagaagctgcagcaagtcatccataagatcagctaagagaagcaacaaaggtggctacactaaacaaaggtttttactgcagataaaacagccttatattggaagaggatgtcatccaggacttttacagccaggtagcaaaataaatgcctgacttcaatgcttcaaagaacaggatgactcttttgttaggggcttaacctgaagccaaagctcatctaccattctgaaaattctagggcccttaagaactatgctacatctactctgcctgtgctctataaatgggacaaagcctgaatgacatcacatctgttacgacatgaatattttaagctcacacctgagaactactgctttaaaaaaagatctctttcaaaatattattgttcattgacaatttacctggtcacccaagagctctgatggagaactacaagaaaattaaagctgtttgcatgcctgctaatacaacatccattctgcagcccatggatcaatgagtaatttagactttcaaggctgattatctgagaaatacatttcataaggctgtagccaccatgtatagtagttccttcgatagatctgggcaaagtaagttgaaaaccttctagaaaggtttcaccattctagaagcatttgcaattcatgggaggaggttaaaattaagaacatttgtgattcatgggaggaggtcaaaatatcaacattaaaagaaatttggaagaagttgattccaatcctcatggatgactttgagggttcaagacttcagtgcaagaagtaactgcagatgtggtggaaatagcaagagaactaagattaaaagatgtgaagagaacttaagatgtggctgaattgctgaaatctcatgacaaaattttaacaaatgagaacttggatgagcaaagaaagtggtttcttgagatggaaactactccaggtgtagatgctgtgaatcttgttgaaatgacaacagagtatttagaaaattgcataaacttagtggataaagcagtggtagggtttgagaggattgtctccgatttgaaggaagctctactgtgggtaaaatgctatcaaacagcattgcatgctacagaggaatcttgaaagaaatagtcaactgatgtagcaaacttcattgttgtcttattttaagaaattgccacagccacctcacctccagcagcttccaccatgatgagtcagcagccacaacactgaggcaaggccactgaccagcaaaaagatcatgatgttgaagactcaggtgatcgatagcatttttaaacagtaaaataatttttgactaaggtatgtacattgacttttttagacataatggtattgcccacttaatagactacagtatagtatagacctaacttttatatgcactgagaaaccaaaaattctgtgtgatttgccttattgccatatttgttttattgcagaactggccaccagaattttcccttcccctagaacgcccttcacccaagccacctgcattttcccctcacccatcatacccacccccattgtctggcctgccctccacctcctccaaaagccttcattgctcccccactgctggactgcattctgactccgtctcaatgtgactcaatggcacttccattgggcactgccctaaagagctcatctccacagtggcctgaaaccaaacccacagtatctctgaggtatgcctatgtagcagtcccataagttatcgtgcactttaagcattaccaagtccagaactgtgaatgctatacatttacagaaataccacttgaaggtttaactacttataactgtttcataattagaattacaaattttgaatattaattattttaattggggggaggggccaagttggttgagtagaaacagctctactctgcagcccccactgagacaaacataaacagcgagtgaattctgcatttctaactgaggtatccagattccctcattgggactgactaggcagttggtgtgacccatggagagcaaggaaaagcagagttgggcgacagttcacccaagagctacacagggcaaagagacctccctcctccagccaagggaggcagtgagggattgtgctacccaaccggggaactgtgctttacccacagatttttgcaaaccccagaacaggtaatccctttgtgagtccacaccaccagggccttaggtcccaagcacaaagctgtgcagacccatagcaggggctccagctggcagccacttgggcagttactgagctgtaggagtttctgcgtactctggtggcttgcagaaatccagtgaagcaggagatccatcaactcccatgagaagagggctgaagccagggagccaagcagacccactcccacagaaccccacaagctaagacccactggcatggaatccccactggctagcacagcacctggagtctgcctaagaagaccaagttcctggggggaagggtgactgccattactgcgggtctagccggtggttttcccccaccagtgctagggagactgggtggtttgcgctgggcagaattcccacagtgcagtacagaggctgtggcagatataccattattgtatatccaaaggaatataaatcattctattacaaagatacatgcacgtgtatgtttattgcagcactgttcccaatagcaaagacatggaatcaacccaatgcccaccaatgatagactggataaataaaatgtggtacatatacaccatggaatactatgcagccataaaaaggaatgagatcaagtcctttgcggggacatggatgaagctggaagccattatcctcagcaaactaacacaggaacagaaaaccaaataccacatgttctcacttacaagtgggagccgaacaatgagaacatatggacactgggagggaaacaacacaccctggcacctgtcgagggagggccggtggtagggagagcatcaggaaaaatagctaatgcatgctgggtttaatacctaagtgatgggttgataggtgcagcaaatcaccatggtacatatttgcctatgtaagaaaactgcatgtcctgcacatgtatcccgaaagttaaaataaaataaatacataagtacataaataaaattttaaaagacaaaaaaaaatcttaattgtatgtgggtagttccctttgattgaaagtgagatagaaataattttttaaaacttactattcaaaatttgcaaaactaaataagagtaaaagaaatttacattttgtccctggattgatacaagacaaaaacatagtgtggaaaagctggagttgaggatgaacgagattctgagaataaaaatccctggtacatagccaaaatttcagaacttcagattttcaagggctataaaataggtaacctcaagccaccgtctccaacagataaaaggaaccaggtaatatctatattccagggagaaagaatagaaaattggctatcactgacaaaacttagtgggaaggagggatctagaaggtgggatggtggagggatccccagcttggggggtggggaggggctgtgcctcagtctccccctcccctgcccctctccctccctctccccctcctgctgcacctccccctccctctgcgcctccccctcccactgcccctccccaacaaaggagccctttgtgacatcaaggccccacctctgtgacgcaggcctgggccccagtccctagtccccacggggatgcccagagctcagttgcttgaaagcaacgcgcctattcacatggagaatcttccctttcctttaaaattacttagtgcctcatcgctaaacgcccccagttccacaccatgggtgttggatatcttcctcactttggtgtttgccctggggttcttcttcctattactcccctacttatcttacttccgttgtgatgacccaccctcaccatcgcctgggaagagaaaggtaaggaaccctcagtcccaacccacagagcttgattctctcctttctttttattattagttccacttttccaaatccagtggagagccttctatgatgggaagtctcagaagagaccagaacatcatccttccagggagaggcagggcagccaggggttggtaggggtagatagtgtactgggatttccatcccaagctctcagtccatctgtgggggagcacaggaggcatcaaggcaaaatcaaaccagtggactcagcaccagtaccagtcatgagactggggaggtctctgtccgagaccaggccctgagccctggctcatcagcccctttctggtgcaggtggctcagggcccagcctcccctgtgtggggtgatctggggcctgtgctgggcccctgagggcctcccaccagggcctggtgtctcctctggtcttctgggaagcagaatcctacctgatagctcagcagtgcctgcgggcctgaacttgggtgttcctggagcagaggaacagggactgaaggtgtccgtggtggacctcatattgaaaatccctctgtgtgtgtgtgtgtgtgtgtgtgtgtgtgtgtgtgtatttttattttatttgtgtgtgttatttttattttattttattttattttattttattttattttattttattttttgagatggagtctcgctctgtggtgcaggttgcagtgaaatggagtgatatcggctcactgcaacctctgcttcctgagttcaagcgattctcctgtcttagagtcctgaatagctggggattacaggcgcccaccaccatgcctgcctaatttttgtatttttagtagacacggggtttcaccatggccaggctggtctcaaactcctgacctcaggtgatcaacccaccttggcctcccaaagtgcttggattataggcgtgagctaccacgcccagccccctcttgctgtttttctaagaagaaaagcagtttatcatccatttaaacaagagtgggaggaagcacacagagctccctgagcaagacagagagagccatgcggttcctgagtgcagcatgctgcggctgggctggggcagagagggagagccggtcctagcttctcaccctttcttgtctcccattgtcatcttgtctctccgcgtcatcttgtctccgtacgtcatcgtgtctcccagtgtccagtagggcggaggcggaggcccagaggcaggatgaaaaaccacagtctgagaggtaaggctctgccagagcacactagggttaatttgatctcatctgtcccgaagggaactgactctgaagaagtcagttgaagaagcctgaggtgggggctcctaggaaggaaatcagaaccccgggtccttctcagattccatgcgggaatgaagccatggtgggccagggactgggcgttacccagcagggggcagtgtgtgtgtcctggggagaccaatgcctgcctggatgcggaggggggtgagggggcctcccgctccctgggaacagctgtccaactctgctaaggctgattcctctttgagaccacctcagtcctttctccccacagggcagttgtgaggactgtgggggtggggggtccgtgtgtggaagccctttgtgaatgaaaaagccctgtcctccatgccttgctattaacgtcggggtcatgtggctttggacacagatgggtggggtccagggtctaattccccatggtcctccctaaagaaacagccactcagcctcctgtgagaacccaggcccctccctcactgccctaacccagtctcctgatttccagctggtagagagtgccggagaggcctggaggagacttcggacctgctttcacaactgcagaggtgaggcacttccccttccctgcatccttcctaccagggctgggacgtgaccccagggccacaggcagcctggagctgacctgggatggggagaccagggggacagaggatgggagtaaaaccctggggcgaggggtagcaggagaattgggcaatcagggtgtggggtggtggaggggctgtggcccgagcacccactctgccctccggccccaccggctcctggctgcagctcgtgcctcctgtctcctgcagcctcctggggccacaccttgacaaaggtgactttggtcagctctccggtccagaccccccaggtgaggtgggcgaaagagcacctgatggagcctcccagtcctctcatgagcctatggaagatgctgctcccattctctccccgttagcttccccggatcctcaagccaagcatcctcaggatctggcctccaccccatcaccaggcccaatgaccacctcagtctcctccctaagtgcctcccagccaccagaaccttcccttcccctagaacacccctcacccgagccacctgcacttttccctcacccaccacacacccctgatcctctggcctgctctctgcctcctccaaaaggcttcactgctcctcccctgcgggactccacactgataactccatctcactgtgactcagtggcatttccactgggcaccgtccctcaaagcttgtctccacatgaggatttggtggcttctgtcccagccatctcaggccttggtggctcaaacagtcatgtttctgcctcctcccggtggcaggagactgccagaacctcgtgcgcctttaactcatcagtccagcaagatcatctttcccgccacccaccagagacctgtcagatggaagctggtagcctgtttttgctcagctctgatggccagaatgtcgtggggatacaagtcacagaaacagccaaggtcaacatttgggaagaaaaagaaaatgttggatcatttacaaatcgaatgaccccagaaaagcacttaaattctttgcggaatttggctaaatcattggatgctgagcaggacaccacaaacccaaaacccttctggaacatgggagagaactcgaaacagctgcccggacctcagaagctctcagatcctaggctctggcaggaaagtttttggaagaattatagccagcttttctggggcctcccctctctgcacagcgagtccctggtggctaacgcctgggtaactgacaggtcttatactttacagtctcctcctttcttgttcaatgaaatgtccaatgtctgcccaattcaaagggagactacaatgtccccactgcttttccaggcccagcccctgtcccatctggggcccgagtgccaaccctttatttcatccacaccccaattccggcccacacctatggctcaggccgaggctcaggcccatcttcaatcttctttcccagtcctatctcctgcttttccatccctgattcagaacactggagtagcttgccctgcatcgcagaataaagtgcaagctctctccctacctgaaactcagcaccctgaatggcctttgttgaggagacaactagaaggtaggttggctttaccctctagggtccaaaaatctcaggacgtctttagtgtctccactcctaaccttccccaggaaagtttgacatccattctgcctgagaactttccagtcagtcctgaactccggagacaactggagcaacacataaaaaagtggatcatccaacactggggcaacctgggaaggatccaagagtctctggatctgatgcagcttcgggatgaatcaccagggacaagtcaggccaagggcaaacccagtccctggcagtcctccatgtccacaggtgaaggcagcaaggaggcacagaaggtgaagttccagctagagagggacccgtgcccacatctggggcaaattctgggtgagaccccacaaaatctatccagggatatgaaaagcttcccacggaaggttctgggggtgacttctgaggagttggaaaggaacttgaggaagcccttgaggagtgactcgggaagtgatttattaagatgcacagagaggactcatatagaaaacatcctgaaagcccacatgggcaggaacttgggccagaccaacgagggcttgatccccgtgtgtgtgcgtcgatcctggcttgctgtcaaccaggctcttcccgtgtccaacacccatgtgaaaaccagcaatctagcagccccgaaaagtgggaaagcctgtgtgaacacagcccaggtgctttccttcctcgagccgtgtactcagcaggggttgggagcccatattgtgaggttttgggccaaacacaggtggggtctacccctcagggtcctcaagcccattcagtgctttaaactggaaaaggtttcatccttgtcccttacacagcttgctggtccctcctcagccacctgtgaatctggggctggctcagaagttgaggtggacatgttccttagaaagccaccaatggcaagtctgagaaagcaggtgctgaccaaagcatctgatcacatgccagagagtcttctggcctcctcacctgcatggaagcagttccagagggcaccgcgaggaatcccatcttggaatgatcatgaacccttgaagcctcctccagctggacaggagggcaggtggccatctaagcccctcacgtacagcctcacaggcagcatccagcagagcaggagcttaggagcccaatcttcaaaggctggagagacaagggaggcagtgccacaatgcagagtccccttggaaacctgtatgctggcaaacctccaagccacaagtgaggatgtgcatggtttcgaggctccagggaccagcaaaagctctctacaccctagagtgtctgtctcccaagatccaagaaagctgtgtcttatggaggaggttgttaatgaatttgagcctggaatggccacaaagtcagagacccagcctcaagtttgtgccgctgttgtgctccttccagatgggcaagcatctgttgtgccccacgcttcagagaatttggtttctcaagtgccccagggccatctccagagcatgcctactgggaacatgcgggcttcccaggagctacatgacctcatggcagccagaaggagcaaactggtgcacgaggagcccagaaacccaaactgtcaaggctcatgcaagagccaaaggccaatgtttccccctattcacaagagtgagaagtctaggaaacccaacttagaaaaacatgaagaaaggcttgaaggattgaggactcctcaacttaccccagtcaggaaaacagaagacacccatcaggatgaaggcgtccagctactgccatcaaagaaacagcctccttcagtaagcccctttggagaaaacatcaagcaaatttttcagtggattttttcaaagaaaaaaagcaagccagcaccagtcactgctgagagccaaaaaacagtaaaaaacagatcacgtgtgtacagcagcagtgctgaagctcagggtctcatgacggcagttggacaaatgctggacgagaaaatgtcactttgccatgcgcgccatgcctcgaaggtaaatcagcacaaacagaagtttcaagccccagtctgtgggtttccctgcaaccacaggcacctcttctactcagaacacggcagaatactgagctatgcagccagcagtcaacaagccactctcaagagccagggttgtcccaacagagacagacaaatcagaaatcaacagcccttgaaaagtgtgcggtgcaacaatgagcaatggggcctgcgacatccccaaatcttgcaccccaagaaagctgtatccccagtcagtccccctcagcactggccgaagacatccggtgcctctagccaccatcaccactgtccaaggcactgtcttctttgggaaggtatctgatttggtcagtcacaaattcttttttagccttccctggagaaaaacaagtccccaagaaaaaattcactctatgtagagaaaaaatattttctctcatgttagtacatgcagaacatttaatattccacaatatatatggttttttattcataagagggtgatggcttttatttgtgccatgcttggtgtgggcttggtttccagaagcgacaggacatggagggatgttgacagtggtgctgtaagcccaccttcatcctgagttccttcactgaaccttatgtttccgtaataccgtctttacacaaacaacaaaaaattctaaaaacaagatgagaaaaacctatgaaggtcccactctgaaataaggttcaacccatctttccactacttactctacctcaaacttcatgcagctgtagggagaaggtttgcagagatgtcacgggactgaacatctccatgcaggctccaggaagtgccacagccgagtaccttcatgtgtcacaaaatagtggaagtttgggtgggagagtgctgggccctgagtttagaagtgggagaagtcttgaccctgggtatcctggtggagaatagataacgtctgcccctgggaagccccttctctccctgacaaaggctgggatggagatgggctctcttagctcagccaacatgcaaagcagagagtccccatcccactgcctctccctttctcgcactctggagtggcagtggggacagaccttccagctctgtgcatgtgtaggtgggggctagggggtcaggggggcagccttcatggaggttgctgagggccgtgaactcccctgccccagatgagtgaatgaccctgctcctgggtcaccggcctttgtctatctcacctacatgtctctcagcttcagtgaagtagttctgggtgaatggagtagggtatgcctgtgtgtgcagaggcttctgatggtgggactctgtagagctacaggggatgcagacagagaattgaaaaggaggcaaagtggcgtgtgtgagggagccatcagtggtgccgtgagccaggagactctgacattccaaccccttagacaggcctagaggggcctagtgtctcatcctggccacaccccagggtctgtctctgctccagctcccagatcacagacccctagaaaaaccacatttacccccaacacggagggccatattagtgagaaggcaaagtgaataaggaagatgaatttcttaacatcttcgataagcttgcacataataatctattgaacttttttttttttttgagacagagtttcactgttttgcccaggctggagggaagtagtgcaatcttggctcactgcaaactccggcccctgggttcaagtgattcttctgcctcagcctcccaagtggctgagatgataggcacccaccaccatgcccgactaatttttatatttttagtagagacggggttttgctatgttggccaggctggcctcgaactcctcgcctcaggtgatctaccggcctcagcctcccaaagagctaggattacaggcatgagccatggtgcctggcctacctattgaattttttaaaggatgtgttgacaataggtggaaaagcaaggactagagaaccccaggcatgagtcgaagtctggtgacctttaatatacacgtagccccaggactgctccctggggaaaggtggcgacttacaagggcccagcagctgagctggggtcacacagcaaatctcccctggctcctgacatccttgcttgttccagagaccagcaagggaagatgcaggcaggcaggatttgaacatacaagggagctggaagtgacctgtccagaatgggcagggtatgggcaggacaggagccatccctgctgtctccctctgctttcagcacagctttcctcctctctgggccctgtccatatgggaaagcaggaggtctccacaaatcatggacaggaggagccaggtctctagagggagttttctctgccttgtgccacatacaggcgtgcaagaggcccacttccgggggcctcatttcaatggtggagaggccagtgccaggcagtgccactgatctagatgacaatggaaatggccctgcccccaacatgtgggactggccggcactggggtgcagggggcagtgggcacagtccccagcctgtggcttctcctggggccaggtcctctctggggcccggataactgaagcagcctccaaggtgggcccagcggtgacagcggagccaggatcagcaggaggagctgggacctggagcagagagcagccccggtcctccgggagctcaggagagtgtggcacagagctgggaccctgaccactgaggatgggccatgcctggctgctgctgggttccctcaggaaaccaagacgcgagttctgggatgtggaggagctggacgtggagcccatggctcaggccaggagaagcgccacaggcaacactgagagaccagcaagaacacaggaaacaacaaccccttagcccttctgcagctcagtctcccatgacatgcagcgaggccagcaatggagagacccacggagacctcccacaggaacctcacagagatatctcgtacagagtgagcacacggggacctctcactgccacagagagagacacactgcagcctccacagagaccccacggagctctcagagtcctcatggtgccccacagagacctagcacagagattcccagagtcctcacccagagaaccccacagaggccacgctgagagacttcactcagtcccacagagacctcccgcaaatgtcagagaccttccatggttctcacagggagatctcacacagagaccccacaaagacctcagagacttcacacagagtcataaaacagggacctcatgcagagactcatgcagctcactgcaacctccggcctccagccccagaaatggcacacggcaccccccactgcctcacagagacctctctcagagtcctcctcacacagagaccttgcctggagacctcccactctccacagagaccttgtatagattcctcacacaggcctcaggttgctccacactcattgcccagaaacctctcacatagaattccctcaaacattccacacagagattctgtagggctttcacagggtcctcacacagggtcctcacacagggacttcatatagtccatggtccctcacacagagacctagcacggagatttcacacagggacttcccacagagaccccacagagacctctggaagatacctcccacacagaccttctgcaaaggcctcatacagaggcctcacaagaggcaatggagccctcttgctgccccatggagtcctcccacagagacctcatgtggcctcacaggcctcgtacagaaactgactcggatttcttagagactttccacacagaactcacgcagaaacctcaaactgaggctccacagagacctcactcagagttctcaccaggagcctggcactgaggcctcccatgcagcgctcacacagcgtcctcaccataggtgagatgcccctcacagatactcctcagagatctggcccagaggcttcacagagacctcacatccatccattctttaggtgcctgagcagccacctgttgacacatccttctcagtggatataaaaccactcagcacagtagcagcacagccgggatatcagttgcactccccaggaaccctgggacacccagatactgtcagcattgcagtgaaggcggttttctgcttggggacatcctcacacttttttttttttttttgtaatagcgctgcctctgaaaagaattatggattccacaggcagacctgcaaaattctttcttccacaggtttccattagcttgaattctgacccacaatttagaaaattcatttttttaaattattttttgagatggagtcttgctctgtcgcccaggctggagtccagtgggataatcttggctcactgcaacctccgcctctggagttcaagagattctcctgcttcagcctcctgagtagctgggattataggtgtgcactaccatgctcggctaatttttgtatttttagtagagacagggtttcaccatgttggccagctggactcgaactcctgacctcaggtgatccacccgcctcggcctcccaaagtgctgagattataggcatgagccactgtgcccaaccaaaaatttttaagtgaagaaaatgttaccaaccttcaatgaaagaaaatatcttatttgttcagtttgttattatccagccaaattacatcaatgtcatatattttttaaagtttgggggagacaagacttgaatttgagatgcctgacttctgtactttgaaaatatgataaaaacctctagaaaatgaaccccagaaatgaaacaaaccagcaaagaggcatctggactcacactggtctcccaggggactgtgcaactagcacataatttcatacagaacagcttggatcacgtttgcagagttcattttatttttagcaagctaataatcatgcaaagatttttcacaaataggtcaaatctctagcaatattcttattgtatcacttggaaaaattatacttcttaataatattattttattccttaaaatgcagtaatgccctcaaatagtagtatgacacatgtttgtcagacatgacttagtcctaatgttccacaaacatagcttaagcagatgggcaatttaaaaggatttattttttaaacagttctatgaaacacgcattctctaagatgggcagtagggatccattttatattcattacagggctaaaaaaggaatgttttgaaatcttacaaaacaaattaatctatgcttgagatatatacatagcctaataaaatgtattgaggaagggacacgttaacatttgagtggaagaaggtatacatttaatcagcatttgtacaataaaaatgaattatgaatggcctcactaattatatacgcagcactttccaaagggtgcactctggtaagactacttacttctcattgctcataagcaaactgttgtccttgccttggtaaaatctattttaacaatagctgttaaagcatatcactagattatccaacgggatgacagggtcacagtcttttctctaagagaggcatagctgacatcaaggctcttttagcctatttgtttcaacaagaaatcccctttctatattcatcataattaaaaaattttaacttaatttttccacttccttataatgtcactgcatcgtaaaataatggaatcgacatggatcttcagattatacatatacatatatatatagttttgtttttgttgtttttttttttttttttgagacagagtcttgctctgtcacccaggctggagtgcagtggcgtgatcttggctcactgcaagctcagcctcctgggttcacaccgttctcctgcctcagcctcctgaatagctgggactacaggcgccagcaaccaatgactggctaatttttttgtatttttttttttagtagagagagggtttcactgtgttagcccggatggtctggatctcttgaccacgtgatccaccctcctcggcctcccaaagtgctgggattacaggcatgggccaccgcgcttggcctatagtttttttcaacagcgcaacttaaataagtttagttatcagaacaaaatagagtcaattagaaaaaaaaattcatacagaaaaatatacttttcaagttgactgttttaacagagttaaaataagtgattatacttcagtcatttgatttaaatttgctcagagtggccagaaaatctagaaacatagaaaatgtccatactaaatagttgattgctatgacacgttgaatgtgctgttcctcaatagtaattcatagttcagtaatctacgcaaaattgcaatgaacaatgtgcattaaagcaacatttccatcaatcagtgtatattcatctgccatatattgcctcagatgatttgagtgtctaatttcacagaataaatttgagcctttaccccagaagaaataatcaacggggctcaatctattaaaaagatattgacaatatttccaggctctattaacatctatattttatttttaattagattcacctaattcaaagcttgtaaatatttttaccatttatatgtgcccagatgaaatggatatcaataattagataatggagaaaacaacaaacacagatcttctttgttgttaaaatattttacgtcagagcactttgctagaaataaagtaatttttaatctccaggcaaaagactgtctaaatgacattcagaatgtattacaaatttagatttagaatagatttatgtttaaaacaggcctcatactgctttcaacaaatcgggcactacagaacagaatgtggggagggtgacaatgatgtgatgacttcttaacactgagcaaagaagcaaaaaacaagttgtctttctacaatgttgatccctaagagtgatttccctttatagattgcaatataattccagttgcattgttattattttacaaagaactcccacagaaaaaactttctggaggttttcccctatatacacacctacattctctgccatgctcacaccgttggcaaagtatggtgcatccagccacagaccatcaaggggcttgataattgcctcctccatataccttctgaggtcggtcaggtttataaccattcgtgtaacacaattcatccttataactgggcctatggccttgtggcttgtcaccttttccaagcaggtgcttgtcatcttggttgctcagaggtttgctgtggcatcttccctcacctgaggccgggctggcctccaccatgttgcaaccagaagagcccacttccgtggggacagagcttccgtgctctccacagccacgtcacgctgccgctgtgcaaatgatgccaactgtaaatcccagaaaactgcaaaataatgctgcgccaggcacagtcggtgaggatttagaggatgctaacgtctttcctaagaaacgtgggtgacatcggccaggcacggtggctcacgcctgtaatctcagcaccttgggaggtcgaggcgggcagatcacgagatcaggggatcgagaccatcctggctaacacggtgaaaccccctctctactaaaaatacaaaaaaattagccggacatggtgggggcgcctgtggtcccagctactcgggagcctgaggcaggagaatgacgtgaccccaggaggcggagctggcagtgagccgagatcgcgccactgcactccagcctgggagacagagcgagactgcgagactctgtctcaaaaaaaaagaagaaaaagaaagaaagaaagaaaagtgggtgacatcactctggttctaatcattttcgtgcttcagctgcccccactggatcagtgtttctggtgaaacgcaatcagttttcggagggcctcaccctccttcactgtaatgatgtttgcagttctttctttctcctctatgccgaaaatccagaattaccaccccctgttccccatggttcacaatctcaaacacgtttctccagtgaccacttcaattcacacagccatccctcagttcaaatattgcctttgaacatcatgagcaagaccacggctctttgtatttctgccacagtttcacaccagttacagattatatacattcttcacgtcaataagtttattttgtagagtgtggtttctggagtcagatgaactctccacctactaggtctgttacttgggcaagtcatttcttgcctagatttaccaatttgttagagttatattactttactccaaaagattttattctgtgaattacattgcttttcttattttttaaaaattgtaaatctagggatttaggcttggttgtttttttaaatatcagtacttatctaaacaaatatttgaaaatttttcttttttctttacgtatattagaaatctggccaggcacggtggctcatgcctgtaatcccagcactttgggaggccaaggtgggcggatcacctgaggtcagcagtttgagaccagcctggccaacatggcaaaaccccgtctctactaaaaatacaaaaaaattagccgggcgtgatggcaggcacctgtgatcccagcaacttgggaggctgaggcaggagaatcacttgaactgaggaggcagaggttgcagtgagctgagattgtgccactgcactcccgcctgggcaacagagtgagaccccatctcaaaaataaaaaaaaaagaaagaaatctgttaacagccttgctatgaagacatttttgtctgtttcttttactttgtgtacttatttaatattaaaacctgtattattgctcagcaaagaggagaatagtttccttgaaggaaaaaaaacatccttaagaacttactagtttaaagctgagcatcttagatttgaaggttgccttacctttttaaagattttttttatgagttgatagaaagtcctaaaatcttaggaacagaaacaattgagaattacaagtcaaatcattgaaatggagccatctgacagtttatgtgttctgctgtgccagtagtgagtgggaacagtttctatgtgggaatataatcagggtcctgactacccctaaaggagctctttcttgtttggtgtgaagccaatacaccaaaccgagagtgagtatcaaacagtgtgggcttttttcaatggccatggaattgcagaagtgggagcatagcctgcaaatcaacttctcagagcctgagaactgaggattcttaatgaaggggctgggtatacagaggaaagggagaaatattcatagcttttcttgggaagggaggtaggtttttttggaatcaaagagccacctcttttctgcctgtttttggtctcttctggccattgtcatggtgattgtcaactgtcaaggtgccagtgggagtgtcatttagcatggaaattggatcataatgaagctagaggtttttcagaggtcaagctgccattgcggattttgccagcttcagccagtttagtcctaagaaggaacttctgaccccagacatcctgttttctaaaactaagcagttaaagctgaatgggaatttagctctgtcacataggcatttgttgggcaacaaaagcagggtagggctccagctaagccacgtaggcactacgatgggcaacagaaaggttggtttctgggcaattcagagaaaccaaggacagctacccccagaactcagagtagccaactgggctgctcacaggagatgccttaactgaaaggtgatcagactccacaggagacccagagaagatgtggagggagctcagaggctgtcctggaggagacgtggagacagctcagaggctgtcccagagaagacgtggaaagagctcagaggctgtcccagagaagacgtggagagctcagaggatgtcccagagaagacgtggagagagttcagaggctgtcccggagaagacgtggaaagagctcagaaactcagagactgtcccggagaagacatggaaacagctcagaggctgtctgcaagaagacgtgcagagagttcagaggctgtcccggagaagacatggagagagctcaaaggctgtccacaagaagatgtggagagagttcagaggctgtcgttactgctgcacttggctgtttttctttggataattattgcaatcaattttagtaattcaggtgttaaatcacagtcaagcacctatttacctagtggtgagttcctttatgttgtgagttcaatgtcatttgtggggactgtggtccagggaggtgttgggaggatgaagttttttctgagtgactttgcaaacataaaaagtcatctaataaagatgctagaaaagcaaatatcctaacttcctagtcagaaaaatgtccaacaccatgtttatttaagaatttttcacaaaaaaaaacagtggtgggagaaaattacacatctgggcccagcaagtaagactttcccttcacaattgtgctgtgggatcccaggcctcggggggctactgccgtcaccgtccccaggctgtgggcccctttgtcagctgctcttctgaaggcaggtctcctgtccatgccttcccctttgctgtccggatggagattggagatgcagcatcatatacagctgacaggtgttaaccttattagctaattctgtttcacgggacacgatttatacactccatggaaatgcttctcactgcctttttttaccacttcaaggtagaagtaggtaatagtgctaaagtcatcttactagaataacaaagtccatggtttgttgtccctaaaaatatttgtattagtttactagggctgccataacaaaataccacagactgagtggcttaagtaacataaatttctttttttctttctttctttctttgtttatttattattattatactttaagttttagggtacatgtgcacaatgtgcaggttagttacatatgtatacctgtgccatgctggtatgctgcacccactaactcgtcatctagcattaggtatatctcccaatgctatccctcccccctccccccaccccacaacagtccccagagtgtgatgttccccttcctgtgtccatgtgttctcattgttcaattcccacctatgagtgagaatatgcggtgtttggttttttgttcttgtgatagtttactgagaatgatgatttccaatttcatccatgtccctacaaaggacatgaactcatcatttttaagaaaatgtggcacatatacaccatggaatactatgcagccataaaaaatttcttttctcacagttttggaggctggaagtccaaggtcaaggaatcagcacatttggtctcttctgaggcctctctcttttcccttgccaatggccaccttcttactgtgtcctcacatgattgtcctgtggtctgtgtgtggtctctgtccacatctccttgtcttacaaggaaatcagtcttactgattagggcccacccatataacctaattttacctcaattacctctttataggtcctctttccaaatacagccccattctgaggtactagaggtgaggacttcaacataaatttgaggcaacacaattctgtccatgacaattgtccaccttagttttatggtgaaccaaggctgtgaaaaagacttgacttggggccgggcatggtggctcacgcctgtaatccctacactttaggaggccaaggtgggtgcataacccaaggtcaggagttcaagaccagcctggccaacatgatgaaaccccatctctactaaaaatacaaaaagaatgagctgggcttggtggcgggtgcctgtaatcccagctactcaggtggctgagatgggagaattgcttgaacccgggaagcgaaggttgcagtgagccgagactgcaccattgcactcaagcctggacaacaagagcgaaattctgtctaaaaaaaaaaaaaaaaaaaaaaagacttgactgaaggcagtgacctaagagtgaagcgataacagctggcaactgttccgcaagaaggtgcaaagcccctgcaggcctgggaaggtgcagagcctgcacctcagatttgactcctctcatagaatcatggaatttaagtgaacctcttccagtattagggaatcttgaatggaaactctaatatcttaatccccagtgtaacaaacttttactacattgttctcatgatgacaaatgtctcatcagaaaatggcttaaaagtataattattatgaaagcagactggcttatttaaaacaaacataatctgaaaactgtaatccaaaaagtaaacatccatatatatatatatatatatatatatatatatatatatatatattcattcattctctttgctttgaaactttcactgaatgacctttgcccattttatcggtcaccatattttagtggtgctatgcagtgacttttgtagagtaatatctctcaaagtgtgcaatgatcaatattgtgttgtcaaaagattctgtagtcaaagaagtttggaaaactttaattttttgattaagcaaagcaagaagtctgagtttcatttattggtttactatgaaaagtgttagaggctttatgatgtgcaagaaggacatgtgtcataatatttctcaaacctatttgacttccaatacttgcttttttgttttttcttcttttgtggagaaatttcaaaaactttggaaaatactttttaagtgagattcaggagtttgataagcaagatgacaaatactaaaaatatacactccaaatatagacacaatgaatactaaataaactcactgtttttagtcaacattattcaaggatatccaaagtttttcatggcataaaatgctctttttcttttcagtaatatgatacatgtgatattcctggaaacttaaaaaaaaatcatcatttatgtgctctcttgtcagtttcatgctgtatttttgatgtagaagaaagaatttggtatcttctcaggaatacattgtcacataaaaatatgtaaactccttcagataaattctcaccttctgcagaatgagtcaaacagcagggggagaagctgaatctagtgttcgcagtgagtgacctgtcttcctcaacactgtcatctcatccattgtcttggatgctcaagaaacggaactatataaatgtggcttctggccttcatatattacagtgccaaagcttcaaagaaccagtttttatttaatacttactttgtttctttgcattttttttcaaaaatacaatatgttgttattaactatagtgaccatgttgtgcagtagatctcttcttgaatatttcccctctcttaaatgaaattttgaatcctttgataaacatccccactccccaccccaagtccagctcctggtaaccaccagtctactctctacttctatgagtttagctttttcagattcgacataaaagtgaaatcatatggtctttctgtgcctggcttgtttcatttaacataatgtcctccaggttcatccacgttgtcacaaataacaagatttcattattttttatggctgaatagtatttcattgtgtatatatactactttttaaaattcattcatccattgatggacacttacattgtttccacatcttgggctaatatataaataagatttaatgtatatggtgttgcagatatctcttcgacatacggatttcatttcctttggatatatacccagtagtgggattgctggttcatatggtagttcatttttaatttttgaaggaacctccatgctattttccatgatgcctttccttcaagtcttctccaacacttgttatattttgtcattttataataaccatcctaacacgtatggggtgatatctcaaagtgtttttaatttgcctttctctaatgattagtaatattgagcattttttatatgcctgttggcctgtatgtcttcttttgaaaaatgtctatttggatcatttgtccatttcttattgagttatttttggttgtctcttcactctgctagcacctattttgtataagacaataatgctcttacattttcaaaatacacagaagataaaaaacatatagtaagtatgatacttgaattgtagtgagacatttaaaattttccaggaaacaattactgtgttttatggttataaggaagaaacatgtacatcattttggggaagaaaaagagaaattatggagtgataagtttaaattgagaaaatgtcaacaaatacaatatacgagagaggctctaggcatttcatttacaaaaatattgtccagtttttgtatgtgtgatgtgtgcttgttccctctttccatatctatctctgtctgtctttctgctatggtttgaatgtatcctccaaaagttcgtagattggaaacttaatccctcttccctcatgaatagatttatgtcagtcctgccctcatgaatggattaatgtcactagcatagtagtgggttccttatcataagcccttttgctcttgctctctcactatgtgatgccccctgccatgttgttaggcagcaagaaggccttctccagaggccagcatcatgctcttggcattcctaggcctcagagctaaatacatttattttctttataaatcactcagtctgtggtattctgttatagcaacaaaaatattaagacactcttcctatttcccctactctccttcctccagcctctttcttacacacaaaatgttactgaaataccaggagttcaatctaggttctgttacttgcacacagaaagccaatcactgagacaatgaatattgccaaggaagaaggctttaattgcatgctacagctaaggatatgggatatcagtctcaattccatctcctcaaccagccgaaattaggggattatatagcaaggaagaaatgtaactatgagcaggaaaacaggaactagggagggctaaggaagcaatcatgacaaataaggaatctggcatctggcatctcattgtctcgacacagtggtctgatgaatttcacttctttgatactttttgagagagctgagagtccatttcctgaggaagaaactcagagaaaacaaatgtaagtttcaagcttcaagaccagaaggatttgtttctatgtttatatttttaaaatctgtctgtggatctattgggtgcatttcaaaaacacatacagaggaaatcccaggcgctgtgctagaattgggaatacaatggtgagttcaaagaggaataattttcctattctcatgaagctaatagtataggatagagaaagcaaacactaatcaaagaaccacacaagcataagattgcaactacaactaaaaaccataaccattcagttaagctaaggaggccaccattgtcacccttctcttaacctttaataatgtattttacaggtaaaatccttaagtaagtcatatttggttgggaagatcaaagaaatcacccagtctcccacatccgaaattgtgcagtccggactgtcaggaacaaaagtgaaagagagacgtcatcaaggccgggcgcggtggctcatgcctgtaatcccagcactttggaaggccaaggagggcggatcatgaggtcaggagttcaagaccagcctggccaatatggtgaaaccctgtctctactaaaaataaaaaaattagccaggcgtggtggcaggcacctgtaatcccagctacttgggaggctgaggcagaagaatcacttgaacctgagaggcagaggttgcaataagccaagattgtgccattgcactccagcctgggagacaaagcgagactccatctcaaaaaaaaaaaaaaaaaaaagaatgactaaaattaagaagattgatgattccaaatattggtaaagatgtagaacaactagaactcccacatattgctgatgaaaatgaagaataatacattactttggaaaatactttggtactgatttaccatatgaccccaaaatctcacttgtagaaatttatacaggaaaaatgaaaacatatgctcacagaaagcttgtatacacatgcttatggcaataaatttatttatagttgcctatcaacaagtgatgaacaaatatattttagtatcttgatactactttccagctagaaaaggaatactactaagcaaaaatagaggatgaagtagtaatatacataacatatatgaatttaaaaacaccatgctgattgaaagaaaacaattatcaaatacacagtgtaatattctattcacagaaagtttgaaaacaaaaaactatagtctctgaaagaaaaccattggttgcaggaaggtggggattcattggccacaaaagggactgaggaaactttttatgggtaatggaaatattttatatcttgatggtggcaccaattatacaactgtatgtacacatttgtcaaaattctaatcgtattatacacaacatgagtgactttaactgtctataaattatatctcaataaaattggtcttaaaagatatatatatacacacacataatttaatatgtattttatatatatctctctctctctcgacaatggagtgaaatgtactctttttttttttttttttgagacggagtctcgctctgtcgcccaggctggagtgcagtggcgcgatctcagctcactgcaagctcccaggttcacgccattctcctgcctcagcctcctgagtaactgggactacaggcgcccaccatcacgcccagctaattttgtttttgtatttttagtagagatggggtttcaccatgttagccaggatggtcttgatctcctgacctcgtgatcgcctgcctcagcttcccaaagtgctgggattacaggtgtgagccaccgctcccggcctgtgaagtgtattcttgtgattaaattgtcacttagcaaacatccagaatgctaaatatccatattatttctcttgttttgcctttctctcactttttctacaagcaccattttgaagaaagcctcatcaactttattaattatatttgtgatcatttgaagacacagaaaattttcttctgcaaaatataaagtcttctttcatctgctctcgtgatccttttattcttctgccaagtgatgtacattaattgatcaactgagttatgcatgcatttactttttcacagatctttgttatgcctgtactagttctatgctagggatatggtatgacactgaacaggatcaatatggtccctgctttcacagagcccacacctaatgtgtggatagtcagaacacagttacacaaacacaagtgggaaataattataacatctgatagatctgaagtcagtagaaaaggtattgaaatggagaaatagaaaggggcctcgctttgataatgaaatcagagacagtttccctgcaacttccttagagggcaaaagccatgtcctttccttctcctaccccaccactgaccccaataaaataccgagcacagaattttcactcaataaattaccttaaaatggatttcaaaatatttataaagcacatttgtgtccattaaagtatgaaaggacatgtatttggagcataaaacccagcacatgatggaaacatcacataaatgaggatcaagaatctaattatgtaatgggaaaatttaaaagaaatgtcaagctggatagagtgtattctaagaaaatgaatacatgtataatagctaaatatttggcatttgagtttcggatgaaaaaatagatgtaaaagaaacagtttccttaattaagaatttaattttgtggggccgggtgcgggggctcacacctgtaatcccagcactttgggaggccgaggcgggcacatcacgaagtcaggagattgagaccatcctggctaacatggtgaaaccccgtctctactaaaaaatactaaaaattagccaggcgtggtggtgggcacctgtagtcccagctacttgggaggctgaggcaggagaatggtgtgaacctgggaggcagagcttgcagtgagccgagatcacaccactacactccagtctgggtgacagagcaagactccgtctcaaaaaaaaaaaaaaattaattttgtcctttggaaggagagaaagaaaaggcagttcacctagaccatcacttgccttttttagttgcagcaaatgccagtttttaaccggatatgtttgcaatgtgtgagttcttctccaagtgctagctaggatgagcttccatacaccgcacccccagctgtggtaatgctttactcatagcctgtctctcatccatctgcctgaattcctgcagaacacagttggaccagcagctcatatttaatcctctcatatgatattaacaccactggtctccatttttgatttacatcttaaagcctccaggctgtaattgttttaccactgtatttcattatttaacatccactacttttatggaaaaaaatgtgtttactcctgtatctcatcttaatgtttcactaactgctaaactcacattttttgttcatttgcattgtttcgagaatctagattgtatttgtctttggaaacagtcacagccacttccagaggtcatttcccatagaccccaaacttctcttctcccagccttggaggtgctgggttctagaaggaggaggcagtgagtccagaagcccagccatatcaggatgacatctaccattcatctgtcctcgtgtgtcttcagcgcctctttcacatgtctgtgtccttagagcttgctggaaccatctttgcttgtctctgtgtattctgagtctgtgactatttggctctaggagtcttctcaacaaagtacaatttctgttgtctttttccaaaaaactttatgaataaaatgaaaatatgagtaatataaaatcaaaatatattttgatttctcatttcaaaattatctacctctgtagtttaatagaactcaattattggccccagaagataatttttttccctaaagtattttctaaataataaccagtagttgacctacgtcctttatatatatcacatagaagatctccacagtacattcttcaaattcagctcagataatccatggaatgctcaagttccctgtaacaaattgagctcctatatctctgtggacttataattgactaataaaagtaagactggtttgctaatgataaagataatttgtaaaaaataaatcattttagtttgaccatgagacgcacacatccattatcattaaatgtgaaaatctagaatatatccagttaatggtcaagtatcaactttatgtcccacacttgccatgtagaagctaagcttttaaaatgcagaattattttctacttttctgttatatgcatatattataaatgacaagtattttaaacactggatttttttaaaaattgctttattttcttctgttttgacaaaagttggctttcaagtttaattaagttaaaaaaaaacgaacaacaaaagtgtattccaatgggagacagataaagcatctttcttatctaaaatacaggaccaggcgcagtggctcatgcctgtaatcccagtactttgggaggccgaggcaggtgaatcacctgaggtcaggagttcgagaccagcctgaccaacatgtctctactaaaaatacaaaattagccggatgtgttggtccatgcctataatcccagctactcaggaagctgaggcaggagaatcacttgaacccaggaggcggaggttgcagtgagccaagatcataccattgcactccagcctgggcaacaagactgaaactctgtcttaaaataataataataaaataaaatatatatttatatatggtatatgaatttgatacattttgctttatttcaggactaatgtaatgctacagaaaaggaatgactctaaactcacttaatttctcctgactataaatagcccttgaccactttcaactttcccactgataactctataacatagggcaagttacttgacctcactgagcctattttgccatctataaatcagctaataggacctaacttataggtttgctgagaggtataagtaagacaatagagtctagcatatggtggggctcaacaaatattagtacattacttacacttttttttttcaccctgctatgcctttcagtttatttctactaaactctaagttattaaaatacaggctgaagtattattaatttccctctgtgttctccccagttcctatcacagtgccagggacacacaggccccataatccttcatggccaattgaactgacagtgaactatgtcttcgtccatttgggatgctacaacaaaataccatagaccgggtgacttataaaccacagaaatgtgtttcttatcgttctggaggctgggaagtccaagatcacggcattggcagattcagtgtctggtgaaggcctgctttgtggttcatagatgggtgctttcttgctgtgtcctcatgtggtgataggggcaagccagtgctcctagtctctttgataagagcactaatcccatttccgagggcccatcatgactgaatcacttctcagcaatcctcccttctaatctcatcactttgggggctaggatttcaacatatgaatttgtgtggggggcacaaacattgaatccattgcaatgaacatcaaaggatggtacagtggttagtgtttgtgtatcatggcctacctaataattttatgtcttggttgctgaaaataaaacaaataaaagctttcatttacatgcttttttagcacaccttttctggaaaaaattctctactttagtgctggtttgtgtggctcataatacatctatggccattaaaatccaatagaactccagagcgaggaagcacattgctgtctttctctatggtgttttccaggcagggtcagaatgccaggatatcatcagacattttttggtagacagtgaggggagggggtggagagggtgcagtttattatacgtaaattatacctcaataaagctggtacttcttttaaaatttgccataattctttatattataaagatataaagaaatttttgcactgtctctcaagtttgtccagaggataaaatcagaggcatataacaatataaaatagtattcaaagatcaaatatttatccaaactttaatactagagaaagatgggcaggtataagcatgagcaatgggaaaatgagaaagagcaggagaaggaaatgttactgaagcaaagtcagagattgcctgcttaaaaaagttttaaaagctaatttacggagatggcttctttccttaaacctcacgaaccaacctctactaccttccaacttttcttcttcagcttcctcacctctctcagccttcatagaactgaagagagttagggccttcctctggattaggctttggtttaagggaatgttgtggctggtttgattttctgtccagagcactcaaactttctccatatcagcaataaggccgtttcactttctcatcacttgtgtgtttactggagtagcacttttaatttcctccaggaacattctctttgcatgcacagcttggccaactgtttggtgaaagaggcctagcttcccgtctatcttggtttccaggatgccttcctcactcagctcaatcatttctagcttttgacttaaagtgagaaatacgtgattcgtcctttcatttgaacacttagaggcgattgtaggattattaattggcctaatttcaatactgttctgtttcagggaatacagaggcctgaagagaggaaaaaagagatgggggatggtcggtggagcagtcagaatacacacatttactggcaagtttgtcatcttatattggcacagttgtggcaccccaaaacaattacaatagtaacatcaaagattactgatcacagatcacataacagacataataatacaaatttaaaatattgcaagagttaccagatgtgatacggtgacacaaagtgagcacatgctattggagaaaatggtgctgatagacttgctcaatgcagggttgccacatgccttcaatttataaaaaatgcagtatctgagaagtgcagtaaagcaaagcacaataaaatcaggtatgaggctgggcatggtggctcatgcctgtaatcccaacactttgggaggctgaggcaggcagatcacctcaggtcagaagttcaaccagcctgaccaacatggagaaacccagtctctactaaaaatacaaaattagctgggtgtggtgatgcatgcctgtaatcccagctactcgggaggctgaggcaggaaaatcgcttgaacccaggagggggaggttgcggtgagcccagatcttgccattgcactccagcctgggctacaagagcaaaactccatctcaaaaaaaaaaaaaagaaactagaaaagaaaataaaaccaacagtaagcagaagaaaggaagtaaaaagcatcagtgtagaaatcaatgcaatagaaaacaggaaaaatcatttacaggaaataaatgaaaccaaactctgtctctttgagaaggtccatagtattgataaacttctattcaggcttatcaggaaaaaaagagagaatacaaaaacaacctatcaggaataagagaagtaacataacaacagattcaacagatgctaaagagataataaatggtaattatgaacaacattgtgccaacagatttgacaacttagatgaagtggacaaatgtctccaaagacacaattatctagtcttactcaaaaacaaacagacagaatagcccggtatctattaaagaaattgaagctgtaatttaaaacctttccacaaagactccaatgctaggtctaaatggcttcagtgaagaattctaccaaacatttaagaaaaacatgataccaattctgctagttcttaccaattattctaattaaagagaaaattgaaaaaggaaggaatacttccgaataacctcttgcacttttctcagacttgtaagtgtgacactgggatgaccagttcatggggagaattttatattctttacaggtgaactggctacaaccacaggcaatttcaatttctttccaaatttcttcaggggaatatctgaggaaaaataaagtgcttttgaaatataaacactttctaggaatacaggaatgttgcttatatatgattttaccaatggtctcatgaaaattgtgtggaggactgtggctataaacacaatggtttgaattttatgtaaattcatagctttttattgttatttttaaatacagaaaagttctgaagatagtaattttatttgccagttttttggaaactttatatctgaggaagatctgctggaagatgtcatttggggtaatgcaaaatatttctggaagacacaagtaaaatgggccctcattgaccaagtagtttgtatagatgtagtgattaaactattaagtagaggggaggttgcaaaaatatttgacaaaatgaaatgtgtgcctgcagtgcaaaaccactgatcctgctcacaaacaggcatagtgagaaagatttctatatgcctggtagaacaacctctgtgggccatcttaagcactggtgattaacacttttatgcattctattacatctgaatttcaccacttaacatgatacttaagctgaattaaaataccttaatactcttgccttaatattcttccaaggtttagcacctggtccttttaataaaaaaaaaaaataggttatggttacctttttttgaaaaggtactcaaatatgtcaactttattgtttctagatatacacccctttgtactgaaaattgtaaaaatagcatgaagtttcctcttattgcaatccaaatttttgaaagccagtaaatctaattattatgctctagacaacttacctaatgctttgtttatccacaagtaactttgcttcaatttcttgatgttgggtttcatctcactgactttgggcttctaaatgggaatatttacgtcctcttcgcttctttgggtcaaatcaaacagtagagctaaagttattcaaatacattcaaactacacagaccccttataaattactagtatcatggtaggaaggaaaatatataaggagaaaaatacatcctggaactcattatcaaaattattggtgtatagtctatactagcatagagtagctttctcaacctgctatgtaaaattgccagcaagaaaaaaaagtgcaagaataaggtctatgactgaagtggctcggtgtcatgattccctactctagcattctcagaaggatcccatccgttagacatgcagaaactgcagcccatccaaatgtgatctgtttaatcaataatcaacagttcatattgaagacagtatttttgctatatgtgcttgtcataatgaaggacggtgtacaaagaacaagttgaaccagacgaacactttaattttgatgccaaaatcaatcactttttgtcataacaccaggcatagataatggttgatccagtgcacactgtctgtattgccccataatttcctgcagcagacatgttataatttgacatactccttgatcattaacacattgcagtagtcagatatacttgtcaagattaagctaaatgtcagtagaagactcagtgaaggcttgaaaatcttgcagcttgctctcagagacactgccaactgaaatgataaatgtcattgggctgtggtactattctcatcgacgtatcaataaataaagggatgctggcgaaaaaatgttcttccagatacctgcccactctgaacctagagttcttttcatcactgtgaaagacagctccctacacaccgcagccatttcctgggaggactctgagctgtgattttaataacagaatgcactcatctgccatttttcttccagaattgcttgtgaatatcctgcatgctatccaagtctctccacccttgtagtctttgtataaatgggttcattttgttccttttaattttttgagacagagtctcactctgtggcccaggctggtgtgcactggcgctatctgggctcactgcaacctccgcctcccaggttcaagctcttctcctgcctcagcttcctgagtagctgggattacaggcgcgcaccaacacgcctggctaatttttatattttcagtagagacggggttttgccatgttggccaggctggtcttgagctcctggcctcaagcgatccactcgcctcggcctcccaaactgctgggattacaggcttgagccactgcgcccggcccctttgttcttatttgttgttattgcagtgggattctaggaggtgctgggagtggagaagttaatcaacatatttagctagcttgaatagacatcccagtattgatagagttgcaatcttaaaaaaagaaagaaagaaagggaaaaaaaagcccaacagtcatgggatgaaaaagtatttgggcgaggatgaaagagtcaaactctcactgtgcacgtgaaatcacaagtatgggtcgggcgcagtggctcacgcctgtaatcccagcactttgggaggcgggtggatcgtggggtcaggagatcgagaccaccttggctaacacggtgaaaccccgtctctactaaaaaaaaaaaatacaaaaaattagccgggcatggtggcgggcgcctgtagtcccagctactcgggagactgtggcaggagaatggcgtgaacctgggaggcggagcttgcagtgagctgagatggcgccactgcactccagcctgggcaacaaggcaagactccatttcagaaaaaaaaaaaagaaagaaagaaaaagaaatcacaagtacgtacacacgcaactgtcctggtactaacacaacattttggtttccttataatattgaaattttattgaatattgaaatacattttattgaagttgagagttgtatcttcttttaccatgaccgccaacatgtatgtgcaataaaagctataagaatatttgcatttgacccctaaaataaggaacttggatttaataatttggcagttgctttgtttcatttaaatttgaatatttttctgttttattttaatagattgttcctattgcattattcaaaggtgttaaaaaaaactctatgtggttgattagagaacatttattatgtatatttatttgtgaatatttataataatgagtgtttattaaatatgtacatattatacattataccaggtacatattgtatatattatacattatataaggtagggaatatacgttgcccatgtggagtttataatatagctggaaaaataatatcaacatatatactgtatgattccagctacttttttttgtttctttttgagatgcagtcttgctctgtcacacaggctggagtgcagtggtgtgatcttggctcactgcaacctccgcctcccaggttcaagcaaatctcctgcctcagcctcctcagtagctgggattacaggcacgtgccaccaggcccagctaatttttgtattttcagtagagatgaggtttcactgtgttgttcaggctggtcttgaactcctgacctcgtgatcctctcacctttgcctcccaaagtgctgggattacaggtgtgagccaccacgcccggccttttgcccacttttaagttggattatttgttttcttattgtagagtttcaagtattctctgtatattttgaatactagccctttatcagatatgttctccctccctgtgacttgttttctaattcttttaacagtgtcacccatgcagtagaagtttttttatttttttaattataataaagtcccacttagcaagtttttcttctataggtcacactatagggttgtatttaaaaactcatagtcaaacccaaggtcacctgtattttctcctgctatcttttagaagttttatagttttgcctttaaatttaagtctatgatccattttgagttaatttttgtgagaagtgtaaggtcagtatctagattcatttttttacatgtggttgtccagtagttttaacaccatttgttaagaagcatatctttttcccattgaattacctttgcttatttgtcaaagatctattgactatatttgtgagggtctctatctgtactctgtgttctattccattgatctatttgtctattctttaccaataccacactctcttgattactgtaagtttacagtaagtcttgaagtcagtaagcattagttctctaattttgttcttctttaatattatgttggcttttctgcatctcgtgactttctatagatttggagtcagctagtcaatatctacaaagtagcttgcttggattttgataagtactgcattgatcccaatactgatctgtagatcaagttgaaagaactgatatcttaacaatattgaattttcttattcattaacatgcagtaagttgattttttagatcttctgtggtttcgttcatcagattttcatagttttcctcagatagatactacacatattttgttagacttatacctaagtatttcatttttggtgctaatgtaaatggcactgtgtttttaattttaaatttcaactgttcattgatggcatatagaaaaagaaatgacttttttaaattaactttgtatccttcatccttgctgtaataacttataaaagattatatacttagaattcattctaggagttttttgtttattctttgtgattttctacataggcactcatggcatatatgaacaaagacagttttatcacttcctttcttcttcttttttttttttttgagacagagtctcgctctgtcacccaggctgcagtgcagtggctcgatctcggctcactgcaagctctgcctcccagattcacgccattctcctgcctcagtctcccgagtagctgggactacaggcacccgccaccacgcccggctaattttttgtatttttagtagagacggggtttcgccatgttagccaggatggtctcgatctcctggcctcgtgatccgcctccctcgatatcccaaagtgctgggattacaggcgttagccactgcgccccgctatcacttcctttcttatctgtataccttttatttcttttttctgtcttattgcattagttaggactttccacacaaagttaaataagagtgataagaggagacatccttgttttgttcctgttcttagtgggaaagtatctcacttttcaggcttgagtatcatgttaagtggaggggttttttagatttaaaaaatcaatttgaagaagtttctctctattgctagtttgctgaaagtttttgttttgtctgtttgtttgttttgttttttgaggcagagtctcacactgtcccccaggctggagtgcagtggtgtgatctcggctcactgcaacctccgcttcctgggttcaagcgattctcctgtctcagcttcttgagtagctgggatataggtgcgcgctatcatgcccggctaatttttttttttttttttttttttggatttttagtagagatgaggtttcactgtgttagccaggatggtctcgatttcctaacctcgtgatctgcctgccttggcctcccaaagtgctgggattacaggcatgagccaccacacccagcctgctgaaagtttttatcatgaatgattgttagatattgtcaaattctttttatgcatctattgataagattacatgatttttcttctttaacccattggtataatggactgatcttcgactgttgaactaggcttgcattccggagtacatcccactttgttatggtatataatactttccttgtttcttttttaaactattgtatttattgtttttaacactttttcacaacttcaatgacaatcaaataagccacctcctgtgttgtgtttctctgtgctgcttgaagctgcctgtgcttacttttggttctacatagcttctccccttagaatgatatacatagtacagcattcaacatatgctaactcttagtgttgttattatctgaagaccctcaaggactgctcatggtgctgatgtggttggaggggacatgacttgaaccatgtcttgtaactttgcatgaattatttacacatgcttgagacaaggttagttttctgcatcaaagaatgagcagggagatgataaagaggtggctagctccatcctgttccagctatggtcattgctgacgtgcactttgcatatacacgctcatccaagttgcatactgcactcaatcagactcaggtgtgaaagaaaggtaggaaagagggacatgggcccactttcagctctggtttattcagctgttatcactgctctgtatgaggactgaaatgaaatcctcagctaatactgaactggaaggagcagcctgtgtgtggtgaagagataaaacctaaaacaatcttaacagaaacaaagcacttttccaaactaagaagagggcgataaatgtagtttgacactttagtttaaaaatacacaaatttaggctgggcgtggtggctcacacctgtaatctcagcactttgggaggccgaagtgggaagatcatgaggtcagcagttcgagaccagcctgcctggccaatatggtgaaactctgtctctactaaaaatacaaaaattagctgggtgtggtggtgtgcacctgtgctcccagctactcgggaggctgagggagaagattcgcttgaacccaggaggcggggctgcagtgagccgaatcgtgccactgcactccagcctgggtgacagagtgagactccatctcaaaaaacaaacaaacaaacaaaaaaacacaaatattagaataacgcctgtgaaacaaaagtgacctgagtttatgtccctgtggccttgacaaaagcctgtggtataatgaggtcacctcatatcttagtgagtttgaagggagtgaggtctctcctgcccccagcttttagaccacactgaagagcttgatcccagttccagccattggatattcagtaagatgtcaataaatcagagtttgtcaagagaaggagggtgaagggccttctaccctgacatgccaggtctcagacagagaggaaggcattagttgcaggagagagaaaactcaggcatgagcaggatggtcaactttaaattctacagctccctcccatggaggagacattagactcacactaagaagataggtctgtaattggtggatggggctgcaggaagctgtaccacagacaaaaagaagaactcaggaatgaggattctcaaaaatgaatgtgttttctctcaaagaatgtatgagagtgtattcatacagtgattctctgttatctatagaagtctaaattccataagaagttcagaaggtcctttgttcctcacttcctgcctgtaagccagtttcatctcccggacacactctgccaccctgtgtgccctgagtcatagcccctctgcactaactatgcttctcccaaaatcagcatactcctttcaccttcctgcctctgcccacgacttcctcttggtctggaatgcccccaacagttcagctcttaaagctcatataccctcaggccatagttgaaaatatgtatatccttgtttattctcaacagttccaataaaaatccacctcccctttgaagtcttcacgactgctatactttaacctccaaagcaaagttagataccccatgatctgtgctcccatgacacccatccacttcgattatggcatgttccacattctaattatttgcttactgtctcctctagttgactttgagcagacaccttgtcttattcatgtctgcatctgaagagttttcacacagggctcacaccacaatgggtgaatgagcactcagagaggaatctgtacccacgtgaaggcatgcacccttcagcactaagcttctgtgatctcataacatcttgccttaatattcttccaaggtttagcacctgatccttttaaacacatttgttaataaacaataaataggctatggttaacttttaaataactagttaatctttattatgaaataagaattttggaagaggcgaagtgatctatatacatgggacggaggaaagtgaatatcaatggcctatgacgcatcattaagtttcttttctatttcatagaattttctactcacattactgtcttattcagtgttcttttgtttggtgttgaaccagcgcaaaatctctgaggttaaaatggaattattctaaaggctggaagcctggtagcttcaagagctagaaccaaagtctggaaagagctccaggaacagctccagctaccctaagtaaatctctcccaggcgctctgatcgcttttcacaacttctctctccacatcacttcagcttttctttccacagattgactatgtctgcttttctaagctgctggttaaatatggaagcaccaacgatcccaaacttaaatattctaagttgaaatgacccatagggaaagaccagtatctctcaatcccaattcccacattttaaagagaaaatgtggttgggtcagttgttctacctttaaataaatagggtcaggtatgggacatgattccataacacaaacatggcaggcagggctcaccattgtggggtcagtcctcagataaattttttttttttttttgagacggcatctcactctgtcaccgaggctggagtgcagtggtgcaatctcggcccactgcaacctctgcctcctggattcaagcgagtctactgtctcagcctcctgagtagctgggattacagatttgcgccaccatgcctggctaatttttgtatttttagtagagagggaagttctaccatgttggccaggctggtcttgaactcctgacctcaggtgatccacccacctcggccacccaaagtgctgggattacaggtgtaagccactgctcctggccaataactttatttatttattattttatttatttatgtttttgagacggagtctggctctgtcgcccaggctagagtgcagtggtgtgatctcggctcactgaaagctccgccattctcctgcctcagcctcctgagtagctgggactacagacgcccgccaccacgtccggccaatttttgtatttcttaagtagagacggggtttcaccgcattagccaggatggtctcgatcttctgaccttgtgatccgcccgcctcggcctcccaaagtgctggggttacaggcgtgagccaccgcgcctggcccagaactttattataggtgggacacacataccaaaagaatctgtgcaccacaatgatctaattcaattttgctttttgagagggtttacagaaagattaaactgactgattaacattgagcgctcttttccccttagaccaaattttagttagctattgtcaactataaagctcattattattcttatgaactttagaatctaaaaagataaatcagtcatttgcctgtttgttaagactttgtctgagccatccctacaagacaggtaaagacagcactcagcacaggactgtggcctacactgatctctccttacttccattatctgcattcacatccatgtcttaaattactgccttctcaaagttaacaactacattagtattttcttgtttactatctttttgttttgttttgtttttgttttttctttttcgagagggtgtctcactctgttgcccaggctggagtgcaatggcatgatctcggctcaatgcaacctccacttcccgggttcaagcgattctcctgcctcagcctccggagtagctgggactacgggcgcctgccaccacgcccagctaatttttatatttttaatagagacggggttttaccatgttggccaggatggtctcgatctcttgaccttgtgatccacccgcctcagcctcccaaagtgctgggattacaggcgtgagccaccgcgcccggcctttttttttttttttttttttgagacacagtctcgctctgtcgcccagtctggagggcagtggcctgatctcggctcactgcaacctccacctcccaggttcacgccattctcctgcctcagcctcccaagtagctgggattacaggcgtaagcccccacgcccggcgaattttttgtatttttagtagagatggggtttcactgtgttagccaggatggtcttgatctcctgatctcggaatccacccgcctcggcctcccaaaatgctgggattacaggcgttagccactgcgcccggcccactctctgttcaactcgggaatccctgtcttcttcctgtcttgaaagcttcagccttctgagacttaagaatacaatttcaggctgggcgcggtggctcacgcctgtaatcccagcactttgggaggcccaggcaggcggatcacgaggccaggagatcaagaccatcctggctaacacggtgaaaccccgtctctacaaaaaatacaaaaaattcgccgggcgcctgtagtcccagctactcgggaggctgaggcgagagaatggcgtgaacccggggggcggagcctgcagtgagccgagattgcgcggctgcactccagcctgggcgacagagcgacactgtctcaaaacaaaaaacaaaacaaaacaaaattcaatttcaaaacctagataaaaactaaatctttggagattcagtgctaaattctcaatttgtgttcactaaaagacgtacacttgggcagtgactaatttgatagttatttcccttggactgataagcacattcctttttttttttttttttttttttgttagagtcttgctctgtcggccaggctggagtggcatgatctcggctaactgcaacctccatctcctgggttcaagcaattctcctgcctcagcctcctgagtagctgggattacaggcgtgtgccaccatgcctggctaatttttgtaatttgagtagagacggggtttcaccatgttgaccaggctggtctcaaactcctgacctcaggtgatctggcctcctcggcctcccaaagtgctgggactacaggtgtgagccactgtgccccacccaagtacattcatttttaaacaattaagaagttttgtaatgacttgtgaaatgaggtgatgaaatataattaaagtaatcactattttaatggtagttctccatggaatatttcacaaaattattcagcaccttgttaagtttttaagaactaataatgaaataatataataataaaccaggaacatagtgttataaatagatacaaaatactttagagattgaagttttgtattcacagagatgggagtgaaataaagtagttgttcttataactcttggcactgagactatgtgacctgtgattttgatatatgagagaaaagccagattttatatgcaagatgttggacaatagatttagagagaaaatgtatcagaatacacactgaggcaataattgcctgtttacagatgaaacaggaaagacaagatatagaacttcaaaataaacataaatggtaatacttagcagcatattgagccaatttatttggagaaaataatgagaacacgcaggacaacgctgatgctatagacaaaaatttatattttttccactcaggagactgtttttagtagtttactactagacaagatgctatgttgaataaagctaatgtacttactctgttttgtttcttctttttttttaagttctggaataattttcaggagaaagaaaatcataagagtttatttaaaatttctttttcttgaaacagatttatattattgaaaaattaaataacaggtcactacataaatatccctgaaatttttttttttctttttttgagacggagtcacgctctgttgccaggctggagagtggtggcgccaccttggctcactgcaaccgccgcctcctgggttcaagcaatcctcctgcttcagcctcctgagtagctgggactacaggctcgcaccaccacacccagctaattttttgtgtttttagtagagacagcgtttcatcatgttgcccaggatagtcttgatctcttgacctcgtaatcttcccgtctcaacctcccaaagtgctgggattacaggcatgagccacagcgccaagccaaaaatgtcggtgaattttcagagactagatccattcagtgaacacagccagggctctgttggatgcaaatgacaaagacacaactcaaacgtactttaactcatgttacaaaatgctaaaggacagaccttagggcataagcagcatctctagaatttagtcttacctcttccatctctacctttctctgtgttggttccattttatttgtttcctgcaatgactcatatcttgtgattgaaaaacaaggggccgggcgcggtggctcacgcctgtaatcccagcactttgggaggccaaggcgggtggatcacgaggtcaggagatcgagaccaacctggctaacacggtgaaaccccgtctctacgaaaaatacaaaaaaaattagccgggcatggtggcaggcacctgtagtcccagctacttgggaggctgaggcaggagaatagcgtgaacctgggaggcggagcttgcattgagccaagatcccaccattgcacgccagcctgggcgacagagacagactccatctcaaaaaaaaaaaaaaaagaagaagcctggtggatattcatttctgcaagaatactcagggagttctatcatcagggaccttttctggacatggtttgcctctccaggccttgataaccatatcttactccccaaaacacttttgtttctgagcatcctcagagcccattttttctgacccaaattgctgctcagtaaagggacacagatatttaagggacacagatatttaagggacctgaggggatggtccaaaaagagtaattttctagagtgtccatatatttttaagtaattgtggaggcatcaatcaggatatcactcttcctccattcacccaccaagagattgggaattgccttgttcaatgtcgaaaggctgtcctggctcactctttcagcactctgcaaaagatgagtgttatcgcaatggcattgtgcccacacacacccagggaaaaccgtagcttttgaaaaatgttataaacaaaataactgcattgaattccaccagataaattacagatcatttctttgaaagttaacaccgtgagaacaatgtgtttgattttctgttttctcaaagtaaaagtttagacaagtatattctagtaatatcattttatttttcatttgagacagggtctcactctgtcattcagtctggagtacagtggtgtgatcgcagctcactgcagcctcaacctcccaggctcaggtgacccttccacctcagcctcccatgtaactgagactacaggcatgtgccaccacacccatctggtagtatctatacagatcagagtttacttctatatggtaatggaacaactttgacatgacagaacattcataagcaattttggcatgtaagtaactgttctgatattcgaagctctcaattgtatgataagcaatccaactcaactagttaaacaaaaaacctctactatataaacattagaaaatcttaccacattttgagtattttagtagctgagtaaaagagacaaaatatatgaacatttaaaatgccctttaatgtcagttaatttttttctatgattataatagtaagagttgtgcgtgtgttctttggtttaaatagcactacattcttctttgatataatttttatatccttcctccctctctctctctctgtgtgtgtgtatatatatacacacacacacaatatgtacatagaatatatatactgacacatacatacattcatatataaaatttgaaattaaaatattaagtatggctgggcatggtggctcatgcctgtaatcccagcactttgagaggccaaggcaggtgtattatgaggtcaagagttcaagaccagcttggccaagatggcgaaaccccatctttactaaaaatacaaaaactagttacgaccggtggcaggcacctgtaatcccagctactcgggaggctgaggcagagaattgcgtgaacccaggaggcagagattgcagtgagctgagattgcaccactacactccagcctgggtggagcaagactctgtctcaaaaaaataaaaaataaaataaataaagaaggaaaatattaagcatgaacataaaaaagaacaagagctggtataattagaattagtgttttgaaacttttctcttaagtacttttggtcatattaatcagttgctctaaaatttcaacatggacattttgaaggtgcacagttgcacacaccccaattgcagagttccagtttggttcagatcgagtaaacacattctgccttatctactgattacactgataatcatggtcaaaatgcataatgttactaacagaagactctgaacgttggataagagtagtaaacattcacccctagacattgccatggggttgaagccccacagcctgtctgtatgctcccctagaggtttgaccagtggggcactgaagcactgaagaagcaagccacacctccatcacatgccctgcaaaagggacaagggaacctttcccatttcaatagctacacatgtacccctgaacttggtatggagctcaggacctgaaggatgacctagcggtgatttgcctaacttgatttcctccttccttcccttcctctttccttccctccctctcatcatccttcctctttcccttcttcctccctccctctctctctccttcttatttctcctctcttattcctcctcttccacccctccttctccttcttctcagtcttcttctttcttcttatgtattcaagcttgatctctaaaacagactgaaactagaactgcacacaggcagactgaaggagataaagacatgaagaaacattcaaaatatcaagaaatccaggagatgattttctgaaaaaattaaaatagaccactagctagactaacaaaaaagaaaagacagaagattcaaataaacaatcagaaacaacaagggcaatattaccactgaccccacagaaatacaaataactctcagagaatattatgaacacctctatgcatataaactagaaaatctagtagaaatggataaatgcctggacacatacaccctcccaagactgaaccaggaagaaattgagtccccgaacagaccaaaaataagctccaaacttgaatcagtaataagtagcctgtcaaccaaaaaaggcccaggaccagacagatgcacagctgaatcctaccagatgtacaaagaagagctggtattactcataccaaaactattcaaaaaagttgaggaggagggattcctcccaaactccttctatgaggccagcatcatccagataccaaaacctggcagatatacaacaacaacaacaacaaaaaacttcaggccaatattcttgatgaatgttgatgcaaaaatcctcaacaaaatactggcaaaccgaattgagcagcagatcaaaaggcgtatccaccacggtcaagtagacttcatccccgggatacaaggttggttcaacctacacaaaccaataaatgttattcatcacataaacagaactaaaggccaaaaccatatgattatctcaaaagatacagaaaaggctttcaataaaattcaacattcattcatgttaaaaactctcaataaactaggtattgaagaaacatacctcaaaagaataagcaccatatatgataaacccacagctaatatcatacttaatgggcaaaagctggaagcattccccttggaaactggcacaagacaaggttgccctctctcactactcctattaaatatagtattggaagttctggccagggcaatcaggcaagataaagaaataaagaactttcaaatagtaagagaagaagtcaattatccctgtttgcagatgacatgatcatatttctagaaaaccccatagtctcaacccaaaagcttattaagctgataagcaacttcaggaaaatctcgggatacaaaatcaatgtgcaaaaattactagcattcctatacaccaacaaaagtcaagccaagagccaaatcaggaacaaattcccattcacaactgcaacaaaaagaataaaatacctaagaatacagctaacaagggaggtgaaaggtctctacaaggagaactacaaaccactgctcaaataaacagagaaggcacaaacaaatggaaaaacattctatgcccatggataagaagaatcaatattgttggccaggcacagtggctcacacctgtaatcctagcactttgggaggctgaggtgggcagatcatgaggtcaagagattgagaccatcctggccaacatggtgaaaccccgtctctactaaaaatacaaaaattagctgggcatggtgttgtgcgcctgtagtcccagctactcgggaggctgaggcaggagaatcgcttgaatctgggaggcggaggttgcagtgagtcaagattgtgccactgcactccaacctggcgacagagccagactccatctcaaaagagagagagagaaaaaaagagtcaatattgttaaaatggccatactgcccaatgcaatttacagattcaatgctatgcctgttaaactatcactgacattcttcacagaactataaaaaaactcttttaatattcatatggaaccaaataagagcacgaatagccaaggcaatcttaagcaaaaacaacaaagctggaggcatcacgctacccgactttgagctatactacagggctacagtaaccaaaacaacatagtactggtacaaatttatttgtacaaatttattattggtacagacacataaaccaatggaacagaatagagaacccacaagtaagaccacacacctacaactatctgatcttcaacaaacctgacaaaagcaagcaatggggaaaatattccctattcaataaatggtgctaggataactggctagccatacacagaagattgaaattgaacttcttccttacaccatataaaaaaattagctcaagatggattaaagacttaaatgtaaaacccaaaactatagaaatcctggaagacaacctaggcaatatcattcagaacagtcacaggcaaagatttcatgataaagacacaaaaagcaattgtaacagaaacaaacattgacaaatgggatctaattaaactaaagaccttctgcacagcaaaagaaactatcaacagagtcaacagacaacctacagaatgcaagaaaatatttgcaaactatgcatctgacaaaggtccaatacccagcatctataaggaacttaaactaatttacaagaaaaaaccaaccccattaaagtgagaaaaggatgtgaacagatacttttcaaaggaagacatacatgcggccaacaatcatatgaaaaaagctcaatatcagtgatcattagagaaatgcaaatcaaaaccacagtgagataccatctcacaccagtcagaatggtgattttttaaaataataaaacattataaactatacctaacatttatagaacactccacccaacagcagcagaatacatgtttttctaagagaaaatgatatcctgaaacattgttcagcagaactgttacaatttctttttaaaaacctgaaatttcttcttttaattggtaattatttttttaacttttattttaagttcagggttacatgtgaaggtttgttatacaggtaaacctgtgacatggggggttattgtacagattatttcatctcccaagtattaagcctagtactcattaggtatctttcctgaccttctccctcctcccaccctccaccctttgagataccacagtgtgtgttgctaccctctatgtgtccatgtgttctcatcagaatggctattattaaaaagcaaaaagcaaaaaaaaaaaaaaaaacagatgctggcgaagttgtggagaaaaaggaacaattatacaatgttggtgggagtgtaaattagttctactattttggaagacagtgtgatgattcctcaaagacctaaagacagaaatgtcattcagcccagcaatcccattactgggcatatacccaaaagaacataaatcattttattataaagccacatacacacatatgttcactgcagcactattcataacagcaaggacatggaatcaccctaaatgcccaacaatgatagactggataaagaaaatgtagtacatatacaccatggaaaactatgcagctataaaaaagaataagatcatgtcctttgcacaaacattaatggagctggaggccattatccttagcaaactaatacaggaacagaaaaccaaatacggcatgttctcacttatagtgggagctaaacgatgagagcatacggacacacagagggaaacattagggtggaggataggaggagagagaagaacgggaaaaataacaaatgggcattaggcttaatacctggatgatgaaacaatctgtacaacaaacctccatgacacaagtttacctgtgtaccaaactgatatggaagtgctgggaagggaagagcgtggtccctttaaatgatagggaaggggagaagggaagtgctgggtagaggagggcatggtccctggctagggctccacccccacggacctaggtaaggacaggcacttctgctttcatgccgaaatgtagcattttccaagaccaccctggcctgccgtgcccccatcatgggcctataaaaaccagagaccttagcaaggcagggacgcaagcagctggacatcataaggaacacatcagcagaagaagacacaagcagctggtcatcgaaagcacactggcggaagagcaggccaacagacacctgcaggccatcaggccatcgatggagtctcgctctgtcgcccaggctggagtgcggtggcgcgatctccgctcactgcaagctccgcctcccgggttgacgccattctcctgcctcagcttcccgagtactgggactacaggcgcctgccaccacgcccaggtaattttttgtatttttagtggagacggggtttcaccatgttagccaggatggtcttgatctcctgacctcgtgatctgcccacctcggcctcccaaagtgctgggattacaggcgtgagccagagcgcccagccaggacttctttattaagtggtttttcattaaaggcagtgatgttaaatgtgctcttgcaaagggagtttcttctaaggttgctgttactagggaactgttgctatgggcaccattgctaagaaatgttgctaaagacaatgtttctaaggatattgctaagagctttgttgccaagggtgttgttgctaagattgtcgccaagggaattgtattaggttggtacaaaggtgattgcggtttttgccactgaaatggcaaaaatcgcaatcacctttgcatcaacctaataattaaggacattgttgctgcatatagtgttgcaatggattttgctcctagggcctcttagataagggtgttgttgctaagaaatgttccccacacatactgccaccaaggacatagttgttactgccactgtagctaaatgcatggctgatatggccattattgctctggtcacaattacagtagccactcttgcagaaggagcaattcctatgaccactgttgctaaagacattgttattaagtatgttgctattaatggaactttttcaaagagtgcggttgctaagcacattttgccaagtttttgctaatgatattgttgggagggcccttatgctaaagacatcgttcttaaaggtgttagtattaagggtggtgttgcaagaaagtttttgctaaggatgcatttgctaaatcaaggttggatggtcactgctgccacgaaaactgttgctaaaggcaacattgctaggggcaaaggtgctaaggaaatttttgctatgaaatgtgttgataagattgttgataggcagtttttagaaaggcactttctttgttagtattagtgtgttttgtgttttcttagtatgtttgttagtgtgttttggcgtgctttgctaagaaatctgcactaagttgcttttgctgagggtgtggctgctatggccactgttggcaaagtcattgttgagaaggcattatttctaagtttattattgctaaggaaattgttgcctttttgttaagagaattgtattagtttcctagggctgccatatcaaagtaccacaaacgaggtggcttaaaataaaagaaatttctcttacagttctggagcttagaagtccaaatcaggtggtggtagggttgcttccttctgagcactcggaatcttttccatgcgtttttccttgcttctgatggctcctggaaatctttcacatttcttggcatcactccagtctctgccttcgtattcacatgcccttacaaaacttactctctgttgctaggagcgtgtttgctaaggaaatgcttgctaaaggtatttttaagggcatttctcttaaaggcattaatgttcaagatattgtcacagataagttttggtaccaatgcagttaccaagagtgttgatgttatggccctgttgcaaaggaaacttgttgttaagggtgttgcaagactcttgtgttaatatcgttgtaaagaaagttgttgttaaggatgctgttcctaactgcgtttgtttctatgttgcaaaatgagatatgttaaaagcattgctgcaaaagatgttcttgctaggagcattgctgctgatggaaagtttgcaaaggtaattgttgatggaagcaattttgaaggtcctctttttttaaaaaaaaaaaaaaaaaaaaacaggcagagtctagccctgtcgcccaagctggagtgcagtgttatgatcatggttcactaacctcaaactcttgggctccagcaattttctcacctcagcctcccaagtagctaggactacgagcacaggtcaccatacctgacttttttaaaaaattttttgtagagacagcatctcactatattgcccagactgacctcaaactgctggcctcaagcaaacttcctgcctcaacctttcaaagtgctgggactacagacattagtcaccatatctggtcaagattgtcattcttaaaggcattgatattaaaagtgttattgaagattaaggttttgctatgagtgctgttagtaactactgttgctaagaaagctgttgttaagggcatttttgataagggtactattggtaaggttattattcttaagggtattgctatggtttggatgtttgtcccctctaaacctcatgttgaaatttgatccccaatgttggagatggggcctaatgggaagtgtttgggtcatatgaccaaatcccgtattaacagattaatctccttccttgaggctgagtgtgtcgtctatcagttcctgccagagctggtcgttaaaaagagcctgagacctttctgctctctttctctctctctctcatcatgtgagctctgcacacaccagctccccttcatcttctgccatgagtggaagcagcctgaggccctcacctgacacagatgtccaatcttgaacttcccagccatcagaattgagaaccaactaaatagtttttctgtataaattacccatcctcaggtatttatttcgagcaacacaaaatggtataaggcaggtgttgatgtcaaaaaagttttgtaagggcattgttctttaaggccttgaagttattgtgcaaagaaagttttgctaagggtgttactgctatgactagtgtttctaaggaaactgttgctaaaagcactttttttctcagagtattattcttaaggacttaattgctaagagaatggtagtaataatatttttgccaaggttgttgtggctaaggaagtcattgctgagggtctttcgttaaacatgctgttcttaaaggcatttttgttttgttttgttttgttttgttttgagacagggtctcactctgtcacccaagctggagtgcagttgcgtgatcacagctcactgcaggcttgagctcctgtgctcaaagtgatcctcctgcctcagtctccaaagcaactgggacaacaagcacacaccaccatgcctagtgtattagactgttctcatgttgctaatacagacatacccaaaactgggtaatttttaaaggaaagacatttaattgactcacagtccccatggctggagaggcctcgcaatcatggcggaaggcaaaagaggagcaaagtcacatcttacctggcagcaggcaagagagcttgtgcagggaaactcccctttataaaaccatcaaatttcatgagacttattcactattatgagaacagcatgggaaagacccacccccatgattcaattaccttccattgggtccctcccataacacgtgggaattatgggagctacaatgcaagatgagatttggatggggatacagccaaaccatatcatgtagctagctttttaatttttttaatttttctttttgtagagatgagatctcactacattgcccaacctggtcttgaacccttggtctaaagcaatcctcccgatcccacctctcaaagtgctggaattataggcatgagccactgtgcccagccaaaggcattgatgttaatgttgttgttggatgtttttgctaaaggtgctgttactaagaacactgtggccgtggccactattgcagaggctactgttgctaagatcattggtgctaaaggtgctgttcctaaggaaagtgtgttgaatttaaggaaattgttgttatgggctattttcttagagtcattgttcttaaaggccttgatagtaagagtgttgaaaataaaacagattttgctacaagtgatgttgataagggagctgctgttatgagtactgtttccaaatgtgatgttgctaagagccaattgctaagggtactctagctaaatacattgttaataaggacattgctgcaaatagtgctgctcacagagttgttgttaatggtgctgtttctaaggacactgttgatactgcaccaatgctaagggcctggttgttcatggcatttttattaaaggcagttataataatgaggttgtttttaaggtgttgatgccaagagtattgtttctaaagatatttttgctaagcagctgttgctgatggccttgttttatagccactgtttctatgggaaatgatactaaaggttttgctaaattggcttttttccaagggtgctgtgcaaaggttgttaagtactgttgtaaggaaaatattattatgaatattattgttaaggccattgcctataagagttgctaaaggacattgtgagtcctttatcctatataaatataaaggatatttatattaagcacattgtcactgaggaacttgctgctaggtgttttgttgatgtggcctattgttgctaaggatattgtcactctgacaatgatattaggggcattgtagctaaggacattgacattaaggctctgttactaagactcatttttgctaagggtatttttgctaaggatgttgttattaagtacatttttgctagagcattcttgttcagtgtgttgttgctaaagggctagttgctagaagcacttttcctagaataattgttgcaaagagcattcatgctaaaatgttgatcctaagaccactgtttctaagaaactcatttgaaggacactgtcactgtgagtgtcgttgctaaggttgttgttgtaaaatcctttatggctaagggcattgttactatgttcattattgttaagtgtattacagtaaagaggcattgctactaaatacactgctgttaatgactctattgctcagggacttaatcctaagggtattgttgcaaagagagttaaggatgttgatgttaaggtgttgtttgaaagtgtgctgttggccgggcacgctggctcacgcctgtaatcccagcactctggaaggccgaggccggtggatcacttgaggtcaggagtttgagaccagcctgaccaaccaacatggtgaaaccccatctctacgaaaattacaaaatcagctgggcgtagtggtgcacacctgtaatcctggcttcttgggaggctgaggcaggagaatggcttcaacctgggaggtggaggttacagtgagccgagatcacgccattgcactccagcctgggcaacaagaaggaaactctgtcaaaaagaaaataaagtgtgccgttattagaatcattttggctaaggggtgttggtttgaatggtggtattgctaaggagactgatgctaaaggcactcttagtaagtgcaactgtcgctgaggttgatgttccaaaaggcactgatgttaaggacattgttgctaagcctgttttttaaagtgtgctgctgttatgggtattgttgttaagggtgttgtaagagaaatcattgctgagtaccactgctgctgagagcattgccactaagatctaatattgccaaggacagtgttgctaaggccgttgaacttaaatgcattttagtaaaggcattgttcctaaggctattgttaggggctgttgcgaaggaactgtgttaaagatattattgttatagtcgttaaatctaagagttttgatgttaagggccctgatgctaaaaacacgtttagataatttttactacaactcattatggctaagaatgttgatgttaggtacattattgcaaggcactttagtaaagtgtcttgttgctaaatgattattgctaaaggcactgttgctaaggggactgtttcttagtgaatccataagagctttgttgctaagggccatttttgctaagaacattgtttctaagggtgttgaagttaaacacgttattactgaaagcactgtggtaaaggcatcttacctaagggtttactgctaatagcactgttactcaaggaactgaggctaagggcattgttgctgagggggttgttattaagggcatttgttatgaaaggtcattgtgtctaagtacaattgcttctaaggacattgtttgaagggcattatttcaagggtcattgttgctaagagcattaatgtcaccgacagtgttgttcctaagggaatgttagtaagagcattgtttctaagagtattgttacaaaaggactcttgctaaggacattgttgcaaatacattttggtaaaggcattgttcctaaagggattctggctaaggacactgttacaaggggcatcttttataagggcattgttgctaaagttgattttactaaaggccattttagctaaaggcactgttgctaagtacactgttgtcaaggatgttgttgctaagggtgctgttgttaagagcattatgttctaaaggatccgttgccaagggaattgatgataattgcgttgtttcttttttcttttcttttcttttcttttcttttcttttcttttcttttcttttctttttttttttagatggattctccctctgttgcccaggctggagtgtggtggcatgatctcagctcactgcaacctctgcctcccaggttcaagtgattctcctgcctcagcctcccgagtagctgggattacaggcgtgcaccaccatgcccagctaattcttgtatttttggtagagatggggtttcatcatgttggccaggctggtctcaaactcctgacctcaagtgatccacccacctcagcctcccaatgtgcttgggattacaggcatgagccaccttgcccggcctgtagttgcattgtttctaagggcctttgttaaggcactatgctaatgtttttgctaaaagtcattgttacaaaagctgtggttactaatgatgttgctgccatggaacacgtgcctaagggcgatatttcaattggcatcgatagtaaggtcactgttgctaaggaagttatttctaagtgcattgttcctggagccattgtagttatgggtgatgttcataagagaactgttgaaggtcattgtggctaaaggcattattactattgctagtgtttctcatgatgctgtttctaccagcactgatcctaaatctcgtgttgctaagagtattgttactgagggtattactgctaagtatattgttgcttagggtactattgcttagaatgtttttgtatattattgttaaggacactgtttctaagatcattgttcctagggtgttaatgttggcaagggacatttttgctgaaggcattgtgactaaaggcattgttgttacaggtattttcttcaaagggcattgttgggaaggggacatttctagagtcactcttgctaaagactgttgctaagaccattttactaaggtcaatgctaacagcattattaccaaggctttatttttatggctcactgttggttgctaaagtcattgcttctaagggccaagagggctgttgtcaagaatgctggtcttaggggatttttgctaatagtaatattgttaggacattgttgcaaagagtgtggttgctaagggccattgtttataaggtaaacaatggtaaactcttggtaaggcaagtttggataagagcactgttgctaagggcactggttataggggtgatgcgcatgatttttttactaaggacattattaagaatgtcatttctaaggtcagttgtttacccctttcttgctaatggtactgatgttaagagtgttggttctatgagtattaccattcagagcatttctccaggagccattgttgctaagttcattgatattatgtattttgtagctagggcattgctgtaaagtgtgctgttgccaacaacactgttgctgatgtcattattgctaaggagttgatactaaaagcatttttactaaggtgccattggtaagagtgctgttgttaatgccactataaaggacatttttgtaagggcattgttgctaattgctttatttctaattttgttattgctaagggccatggtttttgaaggtattatttctaagggtgtttttgctaagatacactaacaggccatggtttgaccatttccaaagtaccatggcaatttatagaggtaaatggacataccattgttcctaagggcattgttgctatggacattgattttaaagacattgttgccaatggcattgttgcaattggcataattcccactatttctacaggcaattatgctaaggctgttgttgcttagagatttgtcagtaaggtgcaccattgctaatgatgttgctgctaaggacattgttgttaggggccattgttgttatgttatgagtgttgtctctagggtcattgttcctaagggccatttttgttaagggtcttgatgctaaaggccatttttttaaaggacattttggtaaaggtattcatttcaagctatttgttgctaaggtcattgttgtttggggtggttgttaaggtccatgattgctaatgtaagatattgcttctaggagtgttaatgtcagtcaaaggtgttgctaagagcaactgtggcaaatagtgttatagctgagggcatttttctaatgttactgttgcttagattatgttgccaagagtcttttggctaaaagggttaatattaacaatgttgtcttaaagcattattcctgatggtgtctatgctaagggtattgttgctatgggatttgttgctaagggccattattaacaagtcattgttgtgataggcatatttttaaaagtgttggtgctaagggcaattgttcttaaggatgtttttgccaagggcattagtggtaaaaaattgttgcgaaagccatttttttctaagtgggttggtcctaatgtatcccacaccatgaaatcactacctcactactcttcacctctcccactccatacaccatatttccttgtatcagacacctgctgacatcaccagtataggatcttattagaacaaatgaggcaagtagagcaaagtgggcatctctcagggaacaagagtgtccagtgcaaagtatcagcccattccaaccttaggacaggtgccaggctgattaggggcctcaggtttgagctagtgaccctgaccctttaagctctgagaacttaaagctggctgagctccaaccctaaatgttttgtcctatgagtcattatctgtgagctatttttaaaaatattttggacttcatctatgtttttcccctaatgtgtttcaattttgtggggactctagtggaaacagaggaagtcatttattgttcttaaatcttaaatgcatctttccaacctgtcaatgcacataacttaatcaggtctatgttcatgcataagatagttccatacatgaagcatctcacacttcaatatgctctctatatacaatatttttccacttaaaatatccactaggttgagtgaggacatcgatagccagattttcacatatatttgaaaaaaagagaggtaagaaaactcaaaaatatctgtaaaagaaacaaacacatttggagcacgtgccttactaccaatcaaggttttagaaagccagactcatcaagacagtggtataggcacagtgagaggcaaagtagctcacaggaaaagaccagaggcccataatcatacttagcatttatatccacatggtgtcttacagaggagacacacacatcagtgaggagagaaaatgtaatttaggattagcatacttggtgattaactggtttaaaaaaatgtgtaattgttaagttaaaaatataaataacaaatttttcaatagcaaactcaaatgctatgaacttaggggtaaatttcaccaaagataaaaagtattttatagtcccctcactattgtaagaaatttaacctaccctgggagatgaatactatggtttcaccattttaaaggtgaacttattcataagagaaaaaaaataaaagcaaataaatggagatttatactgcaaatatcaataggaaaagtcaaaatcataaaaaatatcaattccacccaaattgtcaatgttaattccagccaaaacctcaaccagatttcctaatgtccttcataagctgatgcaaaattaatatgaaaaaataaacctcacaccaaagaaaaccaaagacactctcatgcagtaataacataagagaaattatctactggaccttacaatttatgatgaaaataaattaattaagatagctttgtattggaaaaaatagagacaagccaatgaaactgaagaaacaaaatggaaacagatacctatgagaaagtggaaacagcagggcaatttagaaagatgactattttaaaagctgtcatggccaggcgctgtggctcacgcctgtaatcccagcactttgagaggtggaggcgggcagatcactcgggcggatcacttgaggtcaggaattcaagaccagcctgaccaacatggtgaaaccccctctctactaaaaatacaaaaaactagcctggcgtggtggtgggcgcctgtaatcccagctacttgggaggcagaggcaggagaatcgcttgaacccgggaggcggaggttgcagtgagccaagatcacaccattgcactccagcctgggtgtcagagcgagactccatctcaaaataaataaataaataaataaataaataaataaataaataaataaaataaaataaaagcagttaaaccattcagatatccatattgaaacattgtggatccgtacttacgccttacactaaattcatcccagtgggattaaaaacttaaatttgaaacaaaatatgtgagtcatttagtaaaaagaataagagaattttcttatgaatactgtctgaaacaaaaccacaataggaaaagataatttaactcttccacattgaaaagaaaaaaatctctcttttttttttttgaatggagtcttgctctgtcacccaggctggactgcagtggcgcaatctcggttcactgcaagcccagaccccgggttcacgccattctcctgcctcagcctcttgagtagctggtactacaggtgcctgccaccgcgcccggctaattttttgtatttttattagagagggggtttcaccgtgttagccacgatggtctcgatctcctgacctagtgatccgcccgccttggccttccaaaatgctgggattacaggcgtgagccaccgcggccggccagaaagaaaaaaacatcttaaagaaaacctaacaaagtgacaaccaatcttcagactggtagaaagtatttgcaatgtacagatgccacaaaaaatacccagaaaatataaggaatttctagtatcaggagtatattttattgattgccttgaatgctcaataagatcaagaaacatggaaatttataaaactaaatgaaaattcattctatattcttgaatactataattcactgaattatgtatatagtaatatgtaagataatatataactcatgattttaagcttttccattttcttttctttttttttaagacggagtctcactctgtcgcccaggctggagtgctgtggcacgatctcggctcactgcaagctccgcctcccgggttcacgccattctcctgcctcagcctccccagtagctgggactacaggcaccagccaccgcgcccagctaattttttttatttttagtagagacggggtttcaccatattagccaggatggtctggatctcctgacctcgtgatccgcctgcctttgtctcccaaagtgctgggattacaggcgtgagccactgcacccagcctccattttcaaattgatagatatattcagtgcatttcccctaaaaattttcactgtgttttttgagtatttaaacaactattaataattcttaacttcgtacaaaaaaagtcaaaggccgaagaattgaaaacaaatctgtagaataaaaataataataataagatgtaaggaactgccgtacaccaatcaaaatccataatgttagccttcaagacagcatggggcaaatctcctgatagatgaaatagcccaaaggaaaaaaaatagaagtccagtaaatgactcagaattgagtcgatagacatttatggcagatggagcactgtacatcagtggggagacataaatacataggactggggcacttgctcttccaaattcttcatgactccctcttcattgagccctgagggaaatggagagagagaaaagtaagtcggggacaggtgagaccattcactcccagatgcacctctatttccacatcttcaacttagcctcgttaagtgattttgtaaacaagctgagaataccagatggctatggttcgctttgtttgtgtatctccccaatgccaatgtgactgcttcaatagactatgtcacagatatgttgcttgtaatatttgacatgatgtgaatttttattcaagttaagcaacagccatgagagacaagcacagagagcctatccatgtgtttctgacaaaggttccttttttattgttttatgtttatcaagagatttcttttgacacatgtactttttaaaattttttattttgaaataattgtagattcacatgaagttgcaaaaagaaaaaaaggtacgcaaaggtcccttatacatttcaccaagcgtaggattattgttgagaatatgataaatcgcacattcagcctacatagataaatgttctgtggttctactagatatatggttctacatagataaatgttcccaggtctctggggctctctcttacagagaggctaagcatgctttctaacacaatatgctagacatagctgcagtattagtcattcaattattaaacttaataaaacttcaaaaaatattgtatggcatatgtgtgtatgtctgtgtgtgtatacacacagacacacacacacacatatgcaaaagactaatactctattgtaccaaattatgtttaaagaattcaagagaagcaacccctgtgtagacaacagatgcccagattgttcgtatgtttcaaggatatgtgaaggagtttgacgactgctttctcatttggagagaaattaagctgactcttgcagtgacttattctacattagttggtagatctcggtgattcaattgcctcttctgacaattttctttctcagagaaccccaataatcatttctcatgtgcttaaccatccccaggatcttcctatataaaagccattctctatcaaatctttatacttaaggaaagtttgagtacagagtacagtccagtggggccagtgttttccagccaggtcctatggccaaaactttctacaatggcatcttaaatgcaattagcagaaggctgatacctccagaagtaacaaccaagttgctcacttagagtttcaggaagtcagagttcatttgtgggcaaaggatgcaggttacagatattgctcttataggttaagaaaaggaaagaaaacccagcaaagtcaaccatctttctggaaatgttgaaaaaatgtgaaaaaattccatttttttttttgagacggagtcttgctctgttgtatttttttagtagagacggcatttcaccatgttgaccagaatggtctcgatctcttgaccttgtgatctggttgcctcagcctcccaaagttctgggattacaggcgtgagccaccatgccgggctgaaaattccattaaattttaactgtagagcttcttgctcacccctaggagttagaaacttgagaaggcaagctcatccagagttggacaagtcccagctttaaatagagtctcagggaatgaggtcaagtctttgctgggggtcttgtagatgatacacatgcaggtcactattctgagtggagagttttctagcacctagtgtttgtgacactcttgttggaaacaagttggaaaaaagagatctctgtaaaatttgagggagctaagtctaaatctgactcataaacccatcagaagcagctaccttgtgaatttaaacagctctgggagaaattgtgtgaatggaaaaataattccaagttgttgagtctaagatcactgtcttgagtcctgggttagatatagacatacaaggtaaatgatgtagaaagagaaactctaagctggtcatggtggttcacgcctgtaatcccagcactttgggaggccaaggcgggtggatcacctgatcgtcaggagttcaagaccagcctgaccaatatggtgaaaccccgtctctattaaaattacaaaaattagctgggcgtggtggcggccacttgtagtcccagctactcaggaggctgaggcaggagaatcgcttgaacccgggaggcgaaggttgcagcgagccgagatcatgccactgcactccagcccgggcaacagagcaagactccgtctaaaaaaaaaaaaaaagaaagaaaagaaaaagaaaaagcaactctaaactcttaatatctgagttagctcaattcttcaaggttcaggaagatttaaagaatcacttttactttaagggttaaaataaaaagattcctgaagagttttgtcataatcccattagttacctgcatagtttcctagcttaagacctgggggaaaaattgactcaaatctaaactatctttagattcggagcattaaagaagctgcatcctggaagaaacattccagacacagttggacaaataattcaatagctgtctacaaggctgtctatacattttagggaatccttcagtgcttaagagacaaatctcacttattcctcagtcccttaacagctttaagaagaattctcaatttccccgtgcctgcaatggctctgtgtggtagcacaggtaatgcctaggaggagaagcttggaaaattgtaagacctgggggttataagcttcataatttgttcagacatcccatgatattttcctgctgctccgatcaaggttagtgttcagggtcggactgcaggatcatttctgagatcaaaaggcaaagcaagggaagggcaatgcagttgcaatttgtgcaagaagttaaaaagagaaatttattctcaagcaaaatgatttttcatttattcatttttactgagtttaaacagatgtttgggcaagtttagctaccacagctgtgattgtcacacccctctgtctctgtctgaggccctggaaaagaaagtaacagagtgggtttaacatgtattgccaatttctcattcctaagagaagtgaggtataattggcatacaattaactgcacatatttaaggtgtacagtgtgatagtatttgacacgtgtaaaacacaggaaactatcattaaaagtcaagaattaatatctgtcaccccaaaatgttcctgttgccctttggcaagccttctcttccactcctctctatcaaaccagggtagaagggtcttacatgttttgttgctcaaatttatccctaagtatttgatattttgctgctattgtaaatctcctggctatttttttttttttttgtacttttagtagagatggggtttcaccgtgttagccaggatggtctccatctcctgacctcgtgatctgtccgccttggcctcccaaagtgctgggattacaggtatgagccaccgtgtatggcctataaatcataattttaaaatacaatttctgattgttcattgctagtataaggaagaaactttgtatagtcatattctatccttcaactttgcttaactaatttgttagtactagtagctttatcagcttattagttaataataattagtagcatattaatttctgatagtttttgtgtagattccacaaaacttcctgtcatgttacctgagaaacagaaacaattttactttttttccaattcacctgtgtgtttttctcttttcttttggctttattgcctcaattacaatgttgaatagaagtggtaagagctgacattctcatctcattcctgatctcaggaggaaagcattcagtctttcaacattaagcgtgacattacctgtaggttttttgtaaattaccttaatcaggttgaagaagtttcctgctagtgccagtttgctgagagttattttcttctgattatactgagataagatcttttcttttttaatttctcaatttggtgaactacagtgcttgatttttaaaatttttattttattgtggtaagaatataacatgagatctactctcttatgagatttttcagtatacaataaaatatggttaactataggcacagtattatacagcagatctctaaagctaattcatcttgcattaatgaaattttatacccattgataagcaactcctcacttccctttcactcccgtcctggcaaccaccattccactctttgattctatgaattgtactgttaatattttcactatctaagataagcaaattatacgggatttgtctttctgtgattggcttatttcacttggaataatatcctcaaggtttattcatgttgtacatattgcagaatttcttttttaatgctgaatagtatttccattgtatgtctataccacatttgctttatgaatttatctgttaatggacattaatgttgtttctacatctgagctattacgaatagtgttgcaatgaacataggaatggtaatattacttcaagatcctgatttcaattcttttggataaatacccagaagtgggattattggagcaatataatggctctgtttttaactttttgaagaacgttcatacttttttcccatagtaaatgcactatcgtgtattcccacaaacaatgtacaagggttccctttctccacatcccttccaacacttgtctttttttaaaataatcatcatcctgacaggtgtgaggaaatatttcattgtggttttgatttacatttttctgatgattagtaacactgagcatcttttcatatacctgtgggtatttctcttctttggaaaaatgtctattcaagtcctttgctcatttaaaaaatcagattgttagttttatctactgagttgtttgagttcctaacgtattttggaaattaatctttttcccagtgttttcttatagaagctttacagtctcaccttgcatttaagtttttaatccattttgatttaatttttgtgcatggtataagacaaggatccagttctactcttgcatggagatatccagttttcccagcagcatttgttgaagagactgtcctttcctgattgtgcattcttggcacccatgtcaaagatcaattgactgtatatacacagatctatttcttggctccctattctaacccattggtcttatatgtctatctttatgctgttaacatactattttaattactatagctttgcaatatattttgaaattaggaagtgatgcctctagccttgctctttcttctcaagattgttttggctattcagggtactttccaattatatatgaatcttagaattgttttttctctgtctgtaaaaatgctattaggatttttatggagattgaattgaatttgtagattgctttgagtagtgtagatattaagacttccaatctatgaacacagtatgtctttccatttacttgtgtccttttaaatttcttaaattaatgttttgcagtttgcagtgtgtcttttacctccttggctaagtttattcctaagtatttgattatttttgatagtgttgtaaatgggattggtttcctaattttctttcagagagtttatttttggtgtatagaaatgcaattgatttttacatattgttttttatcatactactttgctgaattgacttattaattctaacagttttttgtggagtctttagagttttctgtatattagatcatgtttaaacaggtacaatttcacttcttccttctgaacttgatgtattttttgtattgatcttgaataatcattctgggcaggactttcattactatgttgaatagaagtggtaaaagtgaacatccctgtctttttcctgatattagaggaaaagcttttagttttttacttctgagtgtggtgttagctgtgggattttcatatctggcctcaatatgttgaggtaacttccatctcttcctagtttgttgagagtttctaacatgaaaaagtgtcaaattttatcaaattattatttttaaatctattgagatgattttgtgatttttatcttttattctattaactgtatcacattaattgattttcatatgttgaaccatccctgcaactcagggataaatcccacttggtcatggtgtatgatcctattaatttgctgttaaatttggtttgcaattattttgttgaggatccttgcatctatattaatcagggacatagacctgtagttttctttttgtagtgtcttttatctgtctttaaattcacataatgctggcctcgtgaaatgagtttggaaatattctctcctttttgattttttgggaagagttttaaaatgattggtattaattcttctttaaatatttggtagacttcagcagcagagtcatcaggtcggaggctttgctttgttgggagttttttttattactgattcgatctccttattcactgtttgcctgtttaaatttcctatttctttcatgatgcactcttggtaggttgtatgtttctaggaatttatccatttcttctaggttatcgagtttattggtgtattttttctcacagcagtttcttatgatctttggatttctgtgacgtcagttgcaatgtctttttcatttctgtttttgtcttccttcttcttagtacactgtttgatttttaaatgttaaaacaatttcacattcttaggataagcccccttggtccttgtgtgttattctgtttacataatgctgtaatttatttgctaaaattgcattttttcaactaatgtcatgagagatatcgtctctagtttacttttcttgtaatgtctttgacatttatatcagggtaatgctaatttcatagaatgaggtaggaaataattaccttctcaaaaattttctatgaagagttcatgtaaaattagtattacttcttaaatatttgatataattcactagtgaagccacctgggcctggcattttctttatgtgaaggttttgtaactacaaattgtatttctctaacagatgtagggctattcagattatgtatttcttcttgagtgagatatggtagtttgtgtatttcaaggagttcatctattttatgacaattgtggaaatcattgacatgaagttatatataatattttgttatgattcttttaacatctaaaacctaaaatcatgtcacctttctctttcctgctactggcatttttttcttctaatgcctgattaatctggctagatttatcagctttctgttgatttctgttaacatggtatgtattttttaacctatttgtttttttatatataaagtgtatttcttgtaagcagcatagaatcgggtcttcctaaaaaatttatatgacaattcctgacttttaattgaggtgtttaaaccatttacatttaatatgattatttatatagttaggtttgagtcgataattttgatttttgttcttttttcttcttttcttccatttggatcaaacatttttattacatttcatcttcctttctggttcattaactatgtaaatcaaaagtaaaattctaagcccatcaaccaattgaatggacccctcttctcaaacaagggcattcctaagttaacctggaaaatcagttcaggccatgatgggtagtagaggtcagacatgccacactatactcacgttcctttggaattcaggcacagctgaccagcatttaacattaaaacagagaccttacgactgatgaaacagactcttggtagccattaagataccaacatgacagacagcaagccctaaaagaaataaaaatattttacctcaaaagatatttcttttctctccttcttcttctttttctttgagatggagtctccctctgttgcccaggctggagtgcagtggcatgatcttggctcagtcaccacaacctccgtctcccaggttcaagcaattctcctgccttagcctcttgaatagctgggattacaggtgcccaccaccattcctggcttatttttttgtattttttgtagagacgtggttttgccatgttggccaggttggtctcaaactcctgacctcaagtgatctacctgcttcagcctcccaaagtgctaggattataggcatgagctaacgtgcctggctatatttcttaaacatattttgaaatggccctgcaaagctgtctcttgtgggaaaatctaccttctatagaaaatctccttttatttccaggtcttcttcctgatccgggagagaattaactgagtttggtacctttttaagtctgataaaaaacatttacaatctgttctttctgaagcctgctacctggaggctttatctgcataataaaaaccttggtctccacaaccccttattttaacccttctattaattccagggctttagataaaagctttcaaccaattgccaatcaggaaatcttttaatccacttatgacttgcaggccacaacccccccactgccccttcctcccccttcacattgctccatgtgatggttaatattgagtgtcaacttgattggaatgaagggtgcgaagtgttgttcctggatgtatctgtgaggatgttgccaaagaagactgacatttgaatcagtggactagaagaggcagacccaccctcaatctgggtgggcaccatctaatcagctgccagcacagctaaaataaagcaggcaggagaatgtggaaggactagactggctgagtgttctggccttcatctttctcccatgctgtatgcttcctggctttgaacactggactccaagttcttcggcttttggacttttggacttacaccagtggtttgccaggggctcttgggccttcagccacagactgaaggctgcactgtcggcttccctatttttgagatttgggaactcagactggcttccttgctcctcagcttgcagatggcctattttgggacttcaccttgtgacagtatatactccttaataaactccctttcacatataaatttatcctattagtcctgtcccactagagaaccctaatacaccccacctttccagacctaaccagtgtatgtcttacatgtactgattcatgtcttatacctccataaaacatggaaattcaagctgtagccagaccaccttgggcaaatgttctcaggacctcctaaggctatgtcatgggtatgtccttaaccttggctaaataaacttctgaattgattgagacttgtctctggtattttttggcttaaaattataattctttattttgctaattttgtgtttgctgtggggtaatagtatatgtcttaaacttatcacaatctagcttcaagtgaattataccatttcacatatactattcaaaccttacaatagtatacttgcatttctcccctctcagtctttatgcttttttgtcatatactttatttgtatatacatatgttgcaataacaacacattgttatcattcagtttaaccaattatctttaaaagaaatttacatgaggggaggttccaagatggccaaataggaagagctccagtctacagctcccagcgtgagtgacgcagaagatgagtgatttctgcatttccatctgaggtaccaggttcatctcactggggcttgttggcagtgggtgcagcccatggagcatgagccaaagcagggcgggtcattgcctcatccgggaagcagaaggggccggggaattccctttcctagccaagggtagccctgacagacagtacctggaaaatcaggacactccaaccctaatactgtgcttttccaatggccttagcaaatggcacagcaggagattatatcctgtgcctggcttggagggtcccatgcccacggagccttgctcgctgctagcacagcagtgtgagatcaaactgcaaggtggcagcaaggctgggggaggggtgtctgccattgctgaggcttgagtacataaacaaagtggccaggaagctcgaactgggtggagcccaccacagatcaaggaggcctgcctgcctctgtagactgcacctctaggggcagagcatagctgaacaaaaggcagcagaaacttctgcagacttaaatgtccctgtccgacagctttgaagagagtagtggttctcccagtatgaagctggagatctgagaatggacagactgcctcctcaagtgggtccctgacccacgagtagcctaactgggagacacctcccagtaggggccgactgacacctcatacagcctagtacccctctgagacgaagcttccagaggaaggatcaggcagcaacatttgccattctgcaatcgattagcaataacaaacttctccgagctaaaggaggatattcaaacccatctgaaagaagctaaaaaccttgaaaaaagatgagatgaatggctaactagaataaacagcatagagaagaccttcaatgaccagatggagctgaaaaccatgacatgagaactatgtgatgcatgcacaagcttcagtagctgactcaatcaagtgaaagaaagggtatcagtgattgaagatcaaatgaatgaaatgaagtgagaagagaagtttagagaaaaaagagtaaaaagaaatgaacaaagcctccaaataatatgggactatgtgaaaagaccaaatctacatctgattggtgtacctgaaagtgacggggagaatggaaccaagttggaaaacactctgcaggatattatccaggagaacttccccaacctagcaaggcaggccaatatgcaaattcaggaaatacagagaatgccacaaagatagtcctcgagaagagcaactccaagacacataattgtcagattcaccaaagttgaaatgaaggaaaaaatgtgaagggcaaccagagagaaaggtcgggttatgcaaaaagggaagcccatcagactaacagcggatctctcagcagaaactctacaaggcagaagagaatgggggccaatattcaacattcttaaagaaaagaattttcaacccagaatttcatgtccagccaaactaagcttcataactgaaggagaaataaaatcctttacagacagacaaatgctgagagattttgacaccaccaggtatgccttacaagagctcctgaaagaagcactaaacatggaaaggaacaaccggtatcagccactgcaaaaacatgccaaattgtaaagaccatcgaggctaggaagaaactgcatcaactaatgagcaaaataaccagctaacatcataatgacatgatcaaattcacacataacaatattaaccttaaatgtaaatgggctaaatgctccaattaaaagacacagagtggcaaattggataaagagtcaagacccatcagtgtgctgtattcaggagacccatctcacgtgcagagacacacataggctcaaaataaaaggatggaggaagatctaccaagcaaatggaaaacaaaaaaaagcaggggttgcaatcctagtcgctgataaaacagattttaaatcaacaaagatcaaaagagacagagaaggccattacataatgtaatgggatcaattcaacaagaagaactaattaacccaaatatatatgcacccaatacaggagcacccagattcataaagcaagtccttagagacctacaaagagacttagactcccacacaataataatgggacactttaacaccccactgtcaacaagacagaaagttaacaaggatatccaggaattgacagaaactttctgtcaacgagacagaaagttaataaggatatccaggaattgaactcagctctgcaccaagcagacataatagacatctacagaactctccaccccaaatcaatagaatatacattcttctcagcaccacatcacacttattacaaaattgaccacatacttggaagtgaagcactcctcagcaaatgtaaaagaacagaagttataacaaactgtctctcagaccatagtgcaatcaaactagaactcaggattaagaaactcagtcaaaactgctcaactacatggaaactgaacaacctgctcctgaatgactactgggtacataacaaaatgaaggcagaaataaagatgttctttgaaaccagtgagaacaaagatacaacataccagaatctctgggacacatttaaagcagtgtgtagagggaaatttatagcactaagtgcccacaagagaaagcagtaaagatctaaaattgataccctaacaccacaattaaaaaaactagagaagcaacaacaaacacattcaaaagctagcagaaggcaagaaataactaagatcagagcagaactgaaggaaatagagacacaaaaaacccttcaaaaaatcaatgaatccaagagctggttttttgaaaagattaacaaaatagaccgctagcaagactaataaggaagaaaagagagaagaatccaatagatgcaataaaaaatgataaaggggatatcaccactgatcccacagaaatacaaactaccatcagagaatactataaacacctctatgcaaataaattagaaaatctagaagaaatggataaattcctggacacatacaccctcccaagactaaaccaggaagaagttggatccctgaatagaccaataacaggctctgaaattgaggcaataattaatagcctaccaaccaaaaaaagtccaggaccagatggattcacagccaaattctaccagaggtacaaagaggagctggtaccattccttcagaaactattctaatcaatagaaaaagagggaatcctctctaactcattttatgaggccagcatcatcctgacaccaaagcctcgcagagacgtaacaaaaaaagagaattttagaccaatatccctgatgaacatcgatgcaaaaatcctcaataaaatactggcaaaccaaatccagcagcacatcaaaaagcttatccaccatgattaagtgggcttcaaccctgggatgcaaggctggttcaacatatacaaatcaataaatttaattcatcatataaacagaaccaaagacaaaaaccacatgattatctcaatagatgcagaaaaggccttcgacaaaattcaacagcccttcatgctaaaaactctcagtaaactaggattgatgggatgtatctcaaaataataagagccatttatgacaaacacacagccaatatcatactgaatgggcaaaaactggcacaagacagggatgccctctctcaccattcctattcaacatagtgttggaagttctggccagggcaatcaggcaggagaaagaaataaatggtattcaattaggaaaagaggaagtccagttttctctgtttgcagatgacatgattgtatatttagaataccccatggtctcagcccaaaatctccttaagctgataagcaacttcagcaaagtctcaggatacaaaatcaatgtccaaaaatcacaagcattcctatacaccaataacagacaaacagagaaccaaatcatgagtgaactcccattcacaattgcttcaaagagaatagaatacctaggaatccaacttacaagagatgtgaaggacctcttcaaggagaactacaaaccactgttcaacaaaataaaagaggacacaaacaaatggaagaacattccatgctcatgggtaggaataatcaatatcgtgaaaatggccatagtgcccaaggtaatttatagattcaatgccttccccatcaagctaccaatgactttcttcacagaattggaaaaaactactttaaagttcatatggaaccaaaaaagagcctgcattgccaagacaatcctaagccaaaagaacaaagctggaggcatcacaccacctgacttcaaactatactacaaggcaacggtaaccaaaacagcatggtactggtaccaaaacagagatagagaccaatggaacagagcagagccctcagaaataataccacacatctacaacaatctgatctttgacaaatctgacaaaaacaagaaatggggaaaggattccctatttaataaatggtactgggaaaactggctagccatatgtagaaagctgaaactagatccctttcttacaccttatacaaaaattaattcaagatggattaaagacttaaatgttagacctaaaaccataaaaaccctagaggaaaacctaggcaataccattcaggccatagacatgggcaaggacttcatgactaaaataccaaaagcaatggcaacaaaagccaaaattgacaaatgggatctaattaaactacagagcttctgcacagcaaaagaaactaccatcagaatgaacaggcaacctacagaatgggagaaaatttttacaatctactcatctgacaaagggctaacatccagaatctacaaagaacttaaacaaatttacaagaaagaatcaaacaacctcatcaaaaagtgggcaaaggatatgaacagacacttctcaaataagacttttatgcagccaacagacacatgaaaaaatgctcatcatcactggccatcagagaaatgcaaatcaaaaccacaatgagacaccatctcacaccagttagaatggcaatcattaaaaagtcaggacacaacaggtgctggaaaggatgtggagaaataggaacacttttacactgtgggtgggactgtaaactagttcaaccattgtggaagacagtgtggcgattcctcaaggatctagaactagaaataccatttgacccagccatcccattactcggtatatacccaaaggattataaatcatgctgctatgaagacacatgcacacgtatgtttattgtggcactattcacaatagcaaagacttggaaccaacccaaatgtccaaaaatgatagactggattaagaaaatgtggcacatacacaccatggaatactatgcagccataaaaaaggatcagttcatgtcctttgtagggacatggatgcagctggaaaccatcattctgagcaaactatcgcaaggaaagaaaaccaaacaccgcatgttctcactcataggtgggagttgaacaatgagaacacttggacacaggcccccatcacacactggggcctgttgtggggtggggggagaggggagggatagcattaggagatatacctaatgtaaatgacaagttaatgggtgcagcacaccaacatggcacatgtatacatatgtgaagaaacctgcatgttgtgcacgtgtaccccagaactgaaactataatttaaaaataatagtaataataaaaaagaaatttacataataagaaacaaatatttactcatgtagctataatttctgatgcttttcattcctttgaatagaggtagatttcactgggtatcatttccttctgcctgaagaatttccattaacatttctttgtgatatggttctgctactgatttcttttagcttttgcatgtctgaaaagctctttattttgccttcatttgtgaaaatctgatttccctgagtacaaatactatagaactatttcagtacttttattttctttccgtattatagaaaagctatacttgttttcttgattgcatttctttcaatgaggaatatgctttcattcttatctcattctttgttagtttgtatctcatgtgctccacatctggatgcatttaacgctgtccatcagtagtcttaaacaatctgactgtaatgtgcctggtaattttttcatgtttgagtttattgagatttttggaattgtgaatttgtagttaccatgaaatttgtaaatattcagtcattgtgtactcaaatattcgttgttgttgtttttgtttgtttgttttttgagactgagtctcgctgtattgcccaggctggagttgaattagcacaatctcggctcactgcaatctccacctcacaggttcaagcaattcttatgcctcagcctcccaagtagctggtattacaggcacccactactacgcccagctaatttttgtatttttattagagacagggtttcaccatgttggccaggctggtcttgaactcctgacctcaaatgatccgcccacctcagcctcccaaagtgctgggattacaggtgtgagccactgcacctggccctcatttttattattctcctctttactactttttgggaactccaatcttacatatattattaagctgcttgcagtttatctagcttacagattccctcttcatcattttcggtcttttaaatctgtgtgtgacatgttgtatagtttcagttgctatgatttttattcatgaatcttttcctttgcaatgtttaatctgctgttaatctaatccaatgaatttttatatcagatattgtatttttacctttagaagttttattttagtgtttgtatcttccatgtctctccttaatgtatatagcttttcatctaccttcttaagcaaatggagtacagttacaatggtatttttaaaccattcataattgaagtgattattcatataggtggagtgatatctactatgtttgtcattgttttctgctcattgaatttgctgtttgttatttcctactctttttctgtcttctttttaattgatcattttatatgattccattttatttcctttcttagaatagtaattatacttctcttaaaaaggtttttaatggttgctctacagtttacaatatacgattctgtactctcagtccactttcagatgtcattatattactttgtgtacagtataggtacctcatacagaatactctcaacttctctctcatgtcccttgtaatactgctatcattaattgcacttattcatatttgataatcatgcaatacattgtaatactattatttttaaatgttacactttacatagattaagataagaaaaataaaagatttaattttaataccatttattccccctccaatgcattgctaggcattcttcatttctgttactatatttttatttctagagttttctttcttattgtggtaaaatatgcataacataaaatttatctttttgacgatttttaaatattcaattcagtggcattaagtatatacacattattgtgcatttatcataactatccaccttcagaacttccgtgtcatcccaaaactgcgcattaaacaataactccgcattcctccaaccctttccccaggacttggtaaccactcttctactttttgtctctgaatttgactattcttgtatctcatgtaagtgtaatcatacaatatctctccttttatgtctcatttatttcacttagcataatgttttcaaggttcatttatgttgtgggccgaattgtgtatctctaaaattcacaggttgaagtcctgacccccagtacctcataatgtgatatttgaagaaagaacgtttaaagaagtaatcaaggtaaaatgaggtcatagagatggatatgaagctaatatgagtggtgtcatattgaagagattaggacacagacacacacaaaggaaagaccatgtgaagacagagggaaaagacaaataccaataaaccttggagagtccaggcacggtctgtaattctagcactttgagaggccgaggcaggtggatcatgaggtcaggagatggagaccatcctggctaacacggtgaaaccccgtctctactaaaaaaatacaaaaaaattagcctgggcgtggtggtgggcacctgcagtcccagtactcgggagactgaggcaggaaaatggtgtgaacctgggaggcagagcttgcagtgagctgagatcgtgcttgggtgacagagcgagaccccgtctcagaaaaacaaaacgaaaacaaaacaaacaatcagaaaaaaccttggagagaggcctcagaagaaacaaccttgttgacacacatgattttggatttgcagctccagactgtggtaaaataaatttcagttgtttaagcttcacaatctgtggtactttgtgatggcagccatatcaagataattctttttaaggctgaatgatattctattgaatgtttatccatttattcattgatggtcatttgcatggttttcatcttttggctattgtgaataatgctattacaaatattggtgtacacacatctgttgagtctctgctttcaattcctttggatatatatctggaggtagaattggtgaatcatatgatattctatgtttaatttttgaggaaccaccatactgtcttttgtggcagctgcactatccatttttccattctcataaaaaatgtgccatcaattttttcatatccttgccaacatgtatgattgtgtgtgtgcatgtgcacatgtatattggccatcctagtgggtatgatgtggttttcattgtggctttgatttgcattttcttaatgatccttttatgttcttacaggtcatttgcatatcttctttggagaaatgtctattcaagtcctttgctcacttttaagttggatatttaagagttttttcttgctgttgagttgtatgagttttttatatattctgatattaatcctaacccaattttagtatttcttttatttttcctttcttagagtttccatctctttttttatatcacctatctgttcttgcatgtggtctactttttccattagagtccttaatatattaatcacaattagtttacattttctgtctggaaaattccaatagttgtatcatacttcagtctgcttctgatagtgttttgttgtgacttttttcttgtcatttgtcatgccttgtaatttttttcttgtctgtattgggtaatatggactgaggtaaatagacctgcaacgtggggatttatagctaggaattaagctatgtttagtattttctctacctatacatctaaaatgctgcaaatttctctgctgcccacctttttgtctcctcttgactttgggcttcccaagttactgctctccagagagagtctgtttcttggaactcttttggctataattcactatgtaatgctgtgggattctgttgggatagaggtgtggtctaggggagagagagtgctctgtaatcttccatttaaatctcagctttttatgtggctatgtccaggactgtgaactttacaagtatttctgactcttctccaatggtgtatagcttttcttatccccagccctcaatcctttcccaggttacagaatcttcaatctattttttttgaagctctgaattctgtttttcctccttagtgatacaagaaggctgaaattggctggagtgggaagaatttcattccaccaaccaggataaggctcttacaaaatattttctcctggtgagtgtgctttttttggagaagtttctaagtgtattttatagtgattcctcttcccctttccaactataaccatgagggatctttcttaaatctccaccctgagccctgttggagttcctaaaggtaaaacctattaaagtgttagagccaccctaaaactggggcccttagaactaagaagtttctcctactcaaagtaattgaagcaggcccccttcacaggcaggaaatggagtgcacagaggcactggcaggggcaaactccacttacttggcccgccatgctccacccctcatgggagggggagcatgcaggagactgggtgccagagctggagctagcgctattggacatcggcaagcgtgaactccatacgagccccatgacagcatctacaggagggtgcctgcaacccctgatgccccagaaggagtgttacagtgcccttttagctttgccatcaatggatgacttaagtgttaacagctcagtggaggctcagtgagacagcctttatacctgcacttgtggcccctgagttcttgtctggcatccaggaggaatggagctgcacaaatgaattaaggacggtaaatgtgggggattttattgccgatgaaagtggctctgagcaggaaggggagctggaaaggggacagagtgggaaggtattcctccactgaagtccagccatcccaggccagactcctccttctggcctatgctgtcaagctgtccctctgaagtcaaactgcttcttttcaacatcaaacaatagcttctaaagtccagctgcttcttctcttctcctctctctgctggctgagcctgggtttttctttttttttaattgagatggggtctcacttttgtcacccaagctggagtgcagtggcacgatcttggctcactgcaacctctgcctgctgggttcaagtgattctcctgcctcagcctcacaagtagctgggactacagacggtgtgtgccaccatgcctggctaattttttgtatttttagtagagacaggtatttactgtgttagccaggatggtctcaatctcctgacctcatgatccactgcctcggcctccgaaagtgctgggattacaagcatgagccaccatgcctatctgagcctggggtttttatgggcacagaatggggtggtgaggcaggccatgggtggttttggaaaaggcaacattcgagtgggaaaacagggatgtaagttctcactttggaccatggtattaggctttttggcttcagggtggggtttttgccaaggactcaccctctccagcccagaattcctctgcctcctgtccctatcatattcacactaagcctccaataatgcatcaaaattaccaccgaagagtttctaccagcttatggtttttgtggcctgtgctctaggtaagcaggtctcagctatatatctctagaagtgcttatctctctagatttttgggtaacagtttgccctgtgacctcagttctgtgatggctttaaagaaaagcttttttgtttcttctggctctacttgttgtaagaactgaagtgacaacttgcaatctatttacacattgctgctcaagcaagaagttcgacagtagcattctaagtgttcttgtctactaattctatcatctgtgttaattatgagtcttctgtcatgattgattttatccttattatggatcacatttttctcccttgaattcttggtaatttttcactagatattacacattttgaattttggtatctgaatatttttatttaaatattctccagtgaaacaactataactggtttaaattatcttaaaaataacaatctttaaaaatctctgaaaatcaacttaagaggatacagaaagtgaaaaatgtcttcataaaattctcagtaagaatagtgagaattggagacttgggccctgacctattccctctctctactccctctccactgctcagtgtaacacagtctctactctggataggtatggccacaaagatggagttctctctatactctgctttcagtcaagagctatgatggctcctttggaggataaggccaccagcatagctcattctcccaactccttagcacagaggctcaattccaggtgagtgtagccaagcggtcagaagcttccttctatcccccactcagaggctcctctgtcccccactcaaaggctccatttcatgcatggcagggtgagaatgatgagaccttgataccttcaccccagcttgctcagagggaaagattccagaccagagaggtaagctgagaagttcagagactactgccctcaccagcaccttccacccacaaaaacagcagtgtcactttgagaaaaatgggccactgtctccagtcccagctctagagaagtggcaaagagatttttttcctgggggagaggttataaaaacagagagctctgatgctcttcccaaaggttctgactttatttaaaacagagttggaggagttccactctaagggaactcttgaaaacaatggagattttgttggtaagaaattaagaggaggcttgcagctccatgataataagccaaactataggccagctagttaggaagaccaggtaaagagccagtcacaaagacccctcctggggtcagaacaaacttcaaaatctacccctgaaaaggaacccaaatttaattggattaaacatggggaacttttggcccaggatactgtcatgcacaagaaagaaatcagctggaaattagtgaacattaacagctgggtatgaccaacagagtcagacagcttaacagagagaacaggaaaagagacatcctacatgagttctgctaaaactactgtcatcccaaggtgactgtgccagtgcccaaagctgtgccctctgaggagtgacattagaggcttgctactgttggggaatagatttcaccaaaatagtccatccaagtcactcaataaccaagcaaacaacaaaacaaccaagccccgtggtcaggggaattagtatccagagttgctaaaatgtattatttaaaatatccaattttcaacaaaaaaattgtaagacatgcaagaaaatagaaaagtattacctataggtaggaaaagagaagcaggtaatataaactgcttatgagaaggcccagatgtgggatttggcagacaaagacttcaaagcagttataaattttgttcagagaactaatggttaccagagactaggaagtgtagtgggagggtggggtgagggttgggatggttaatgagtacaaaaaaaaaaaaatagttagaaagaataaataagacctactatttggtagcacaacagagtgagtacagtcaataataacttaaaatagcatattttaaaataacccatttcccatttgccccaagaatactgcactggcagtgagctgcaactttcttttttcctaaatgcaaaatgggttaaagagtgtaactggattgtttgtaactcaaaggataaatgcttgagaggatagatacctcattctccatgatgtgcttatttcacattgcatgcctgtatccaaacatctcatgcaccccataaatatacacacctactaggtgcccacaaaaattaaaaatttaaaaatgttcagagaactaaaggtaaccaggtttgaagaggtatagaaagatacgatgacaatggcttattaaaaagaggatatcaataaagagaattataaaaagaatcaaaaatttttgagttgaaatatacattaactgaatcaaagtttcacttaagtggctcaacagtagatttgaactggcagaagaaagaatcagaaaacttaaaagataagtggatagaaagtatgcaatccaacaaacagaaatgaagaggacctcagaagaaggtgggacaccattaaacacaccaatatatgcatgaaaagactaccagaaggacaagagagagcaaaaagcagaaaaatgtatttaaagatataatatctgaaaacgtcccaaatttgagaataaacattaaacatctacaaaattcaacaaaccccaagtaggatatacacaaaatgcttcacaccaagacacatcatagtaaaaatgttgaatgctatatagagaaaattttgaaagaagtaagagaaaaacggctcatcgcatataagacaactccagcaagagtaacacctaaattttcattggaggttctagtaactaactgttaagtattgcttactcttggtatagttaaatgagtattgattgttctgaatgaagttaattggatattgacagaacttgatacattttctggggttagcttcaagtagccaatgactgaatgcttctaatattatcaaaggaccagtacaaaatattctgtatcagtttatcctgtttgttacatttcttcagatgaagttactcacttgactgcccatgcagtgcaatgctgtggaaagaaatattgtattccatattaacctcaaagtaatggtttgataaacaattgaaatgagtaattaaaatatttgcttaaaaatatgagatctgacaaaggattggagagccgagagctgatctacgaatctccagtacggtttttcaactcaccgtgagaggactaaggatgggtcttggttggataaatgggtatgtttttgtggtggcattggagaaggtagaaaataaaagggaatttatatacaactcttctctacttcacaacaattttgttgtttccaatgctggatctggaagtccctataatggggctaaaattaaggtccaagtgtctggtaatattacaaaaccagacagtatgcctattactttgactaatgacaagaattccaaagagattaatggggtggatgatactctgtctgcatctcggcaagttgggactgcctatgcaaatgctgtgctgcctattgggcggagtagccattatttctctgcacttatccaatccatccccatatgtgtgcgaatggacaaatgaagaagtcctggcatgtctcatcttgctactgtcactatagccaaatgagttactgacttcaggaggaaaggtttgttttaaaattaatgataaatgagagaaaagtgaatcaggctgagtgaagagagccagcaagtgtgtcttacaaaagggaaaaatcaaagataattttgatgtcctaagagaggtttacaacaagtgaataacatgctctcttagctttgactcagatgtcctctggggcaaaagactgccaaaacttcttccactttaaaaaaatgaagaagctgtaaaatgaccaatctaataaatatacttccactattgatctatgtccttctaatcaataaacagattggagctcaggcaatgactctgtgaaacaatactaatgtggctgtctcatatggttcttgtttcacagagaattcaattagtataaatgtatactaatagaagtataaatctcaattgatgtatatcatacaatacagatagctgaagatcagggagaagaaaaatgtataaaatatgtggcacttcctgttggcattacaggatggtttaaattcacaacccctcaggggtgattacaattctttcaaacctgtatgtgcgttttgatcaccaattgattatatgctgttgaaagccaaatgattccatcaaactaagagtgattgttttgttgtaaaaggctctgaccaaaaattatggggtagagtggaatgctgtaaaaggtaagcccagcagacctggaattagtgtgaactgcagagtttgcttatcactgatcattggtcaaggaataaaacatactgattaatagtgctgcttttcatccatgagtccaagatgtttgggagcaggttttaactgtgcatcagtagtgtttaccgttaacagtgagactgatttatgcctggtctcactggaaccttcagagtcctctgctgttggggcttgttgcctagcaagaatatgcctatgtgtccagcagagtataagagacaccagcagagaatccattttggggtttctgatgtgttttgtgcacatgttgaatccttatgtgatagtgaaattgtgtccatataacacttgcacaaggaaaaatggagtttgtgcatggcccttacccagaccccttgctgtgaggcagcctttggctgtgatgtaaatactgactttaatggtattgctatgttgtaccctttcccttaataaatggtagatatttaagcactgtcattttgggccttgtgagccttccttagcaattgactgttgtttaattgccactgttaaagtaccacatttttttgtaatgtggcagttctgtagttttaggccttgtggccatttctcaaggtgtcacttgcttcactgcctagggagttacctgtccataactgacagagaaaacgtagcttctgaggccttcactttagcgtatccttttctgagcccaaacatgatcatgaagtagaaaagcacaataaggaaaaactagtgaaatctgaaaaaaaaagtgtctagttaataatgttatcaatgtttcttagttataaaaacataccatagtaatatgctaatagggaaaactgggtgaggagtatatacaaactatcattgtaatttttctgtaaatacattctcaaataattcttttaaaaaagagtactccttttcatctatacttttctgaaaattaagcatgcagaaaggcatgctttttgaccctcaattcccttgggcactgtgcagtaagctcaagtagcatcatggtatcagagactaaggagaataaaaaagaaggaaacatatttccataacagatggcacctttctgccaggagcggtaagtacctgaggaaggtaagcagcgccagggccagtcccacaccaactccttcatcattcctttttcctcatgagctgcccaaagtagcccctcagtgtctgatgtgccagccctggaggtgctgatatggtcctcgtctaaaggtgggctcttctttcatggctcatctttgcagtgatgctactcaattaactgttaacaacagtgtcaaggaaatacctgtcctctaactaattctaaagatgccatcattctccctcacactatccttgcccacaatataacaagggatgggaattagagacatttttcttgggtcaactgatttattgtcctcatgcttaacctatcagatcaaacttgcagaaagcaagatgctcagggctggggaaaattgttactggtctaggttttaaaaatgattttgtctactttcttttctgtgctcatcaaaccgtaggctaaaataatggcacattaactaaatgctttcttggctaagattatgccacattatattgttttaccaaaagtgagtctgctttctcgtaccaggactgtacttctgggacaaagtagtccttttcattccaattccaaaacctgctgtcttagtttggtagaaataccaaactggtatttctggtttgtgatgcagtgtgaggaggcatcatgatgttggaggaaaatattccaaacaggatgctgaggctatatgcatacaacggaggagaggagaccagttgctttataatcatcctgtgcaaaatgagtaagtggagtgggataaaattaaaataaaggcaaacaaaaagtatataagaatcaccctgtcctccctggcgcccccctccaaacacacaaacacacaaggtgactggggaaatctcagctatctccaaggtcctagaagaataggcaagactagttttaggacaagactaattaatatccagacatagcaggcaggccaaaatctaacagcattgagggaagccaacagaggacacagtcactcagaaaaggaagtggacatgcccagtgcaggtttggctgttagcacccactagaactcaccagtgagttacaacgtttatatacagactaaaagatcttccacagagctcaaactattcacatttattcatattctccacagaattcaaattattccatttttaacttcacattctacagtgagtttttctataggtaaatattttcttatatatgttctataaaatttttgatattacaaaacagaagcttggtacatcagttctaggtgaatattttatctccaattctaaaactgacatatttcctcagaaaaaaatacctaggaaaaatgtcatttattcaaaatatgaaattttattataattgatgtttaatgcaattcactttacgaaggtttttgtggttttccctaaaatttctgttttaatgaaggctcctgatcatcctggatgtcaacaagttttcttcttcatgtgacgtctctgatgcacaataaactgattagtttttctaaaactgattatattcatagggtttcatctcactctaacataaagtttaagctaaactacgtccatttaactaataagccaaatttgtaagagcttaacagactataaacttaactcttgctttaaagcaacaaaaacaaaaccctgatgaagacctggaagtgaattgttcgtttttcagactctagcttccttgaccttgtgctttatggttttgaacacacaggacccaagtttgctgcagaaataacctccaaatccatattatgaaccaggaagactgtgagggtttttcttttttttttttaagggccaagagtaaatgtaatatatatcattagcaccatatcccatggtcagccccacctgaataaacggcatattgggatttttccacaaactatgagcctaatgaaaaaggaaatggataagggaaacaagttcccagcctatgtcacatgagtttctgcactacgtgttatgtggtaaggtatgcattccctcaggacttcccaaatccattacatgctagggttttctctctggtatgcattctggtgtgatgtaccctaagagctgccttacggacaaaagttttcccacattcatcacattcatagggtttctcccctgtgtgaattctctggtgtactctgagagttgaattttgggcaaaagctttcccgcattcattacactcatagggtttctcccctgtgtgaattctctggtgtgcactaaggtgtgatttctgggagaacgttttcccacaatcattacattcataggatttctcccctgtgtgaattctttgatgtactctgagggttgaattatgggcaaatggcttcccacatacattacattcatagggtttctcccccgtatgaactctctgatgtgcactaacatatgacttctcagagaaggttttcccacattcactgcattcatagggcttctcccctgagcgagttctaagatgtgctctgagatgtgatgtcttggagaaagtcttcccacagtcattacattcatagggtttctcccctgtgtgaattctgtgatgtgccctgagggctgaattatcagcaaacgttttcccacattcattacactcatagggtttttccccagtatgaattctctgatgtgcacagaggtgtgttctttgggagaaagttttcccacattcgttacattcatagggtttctcccctgtgtgaattctttgatgcactatgagggctgccttatagacaaaagttttcccacatacgttacattcatacggtttttcccctgtgtgaattctctcatgtccactgaggtatgatttctgggagaaagttttcccacacttgctacattcatagggtttctcccctgtgtgaattctccgatgtgtactgaggcgtgtcttctggaaaaaagtttttccacattcactacattcatagagtttctcccctgtgtggatattctgatgtgctctaagggctgaattatgggcaaatgttttctcacattcattacatttatagggtttctcccccgtgtgaattctctgatgtattttgagggctgaattatgggcaaaagttttctcacagtcactacattcatagggttttctacctgtgtgaattctctgatgtgctctcagggctgaattgtaggtgaaagatctcccacattcattacattcatagggtttctcccttgtgtgaattctttgatgtgccttgagaacagaaatatgggcaaaagaccttccacattcattacattcataaggtttctcccccgtgtgaattctatgatgtgctctgagggctgaattatgggcaaaagttttctcacagtcactgcattcatagggcttctcacctgtgtgaattctttgatgtgctctcagggctgagttataggtaaaagatttcccacagtcattacattcatagggtttctcccctgtgtgaactctctgatgtacactgaggtgtgtcttgtgagagaaagttttctcacattcaacacattcatagggtttttcacctgtgtgaattctctgatgtgctctgagatgtgatgtcttggagaaagttttcccacattcaatacattcatagggtttctcccccatgagaattctctgatgtcctttgagatgtgatgtcttcccatattcactgccaccacagagttccatctctgcatctgttttctggtgtcctatgaggggtgacttgtaagatctcccacagccattgttatcacaaggtttctcttttgtgtgaattctcagatgtttactgaggtttgaattctgacagaaagctttcccacattcattacattcataaagtttgaatcccacataagttccaggatgctgaataggatgtgaacttgaacaaaaggattttgcacattcctcatattggtaagttttctctcctgagtggggcctctcatgctgaatgaggtgtgctttccagtaaaaggattttctgcatttcccatgttcatcagaaaggtagaatttctgatgtgctgtaaagtctgtgtgaattctctgatgtgctgtaaagtctaatttctggtagagggcatctgtacattcattatgttcaccaaatttatctccagcttgtgttttctgatgtactatatgggctgagctctggctaaaattttcttcacatttattgctttcaaaagcactccatcctgtaatagttctctgagattgagtgaggggtgacttcctactgaaattaatccccctttcattacactcatagtgtgtcatagccatgtgaactttattgtattcaacagcggtggttttgtcacaggatgtcccatattcattaagatcagagcatttcccccttttgtcagttctcatgtggttaaataaagtggttttatcaaagtttttttctaaattcatcatccttacaggacttttctcctgttagaaaactctgaggtgtaatacaaattgtcttatcatataaaccttgtccagatccatcacattcaaaagattcctccaaagtttgaaatttccaatgctgacctttcttataactgaaagctttagcattttcaccatgttcataagatttctcttcagcatgagctttctcatgcttaatatcaagctgcagtttctcacacacattcatgtattcagtcttctttcttgaatattttctttcacttataattaattgagaagcaactggcaaattcattctgtgtgagtcacatttacaggatattttttctgaaagctctggagctatttccagattaaatagtttttctaaaactttctgtccttctttactcaatgttttgtcagcatcactgatgaatatttcttgccacagaggtttttcttgtttttcccggatccctttgatgtgatcaactttaaaatatcctaaaatgagaaaaattgaaaatatagtataaatcttacatttctcatggagaagaacttatactcatattttggttttggttttggtttttgaaatagggtattgctctgtcacccaggctggagtgcagtggcatgatcatagctcactgcagccttgaactcctaggctcaagtgatcctcccacttcagcctccctactagatgggactacagggatatgccaccatgtcctgttaattttttttatatttagtggagagagggtcttgctacattgcccaggctgatcttaaactcctgagctcaagcgatcctcctgccttgacctcccaaagtgctgggattacaggcatgagccactgtgcccggcccctgttttgttatgtattttattctattgtttctggtcatgtttccaaatattaaatacttcatgcacacagacagattctctcctcatccatgctgtttataaaacaggtattatttccggggccagtcaaggtggagtagtaacccctttcttcccacatcttccctcttacaattaaaaatccctagagaaaaaacaaaacaacaaaaaaagattaacaaatatacaaatatacgaatactacaaaatggaaagaaagtggacttcaggacttaagaaatgacacagtatggaattccaaggctattctatatcctagactgggtgctgaagaaacctacaatcctgcactgacaggcacagacaaaaagagcacaaagaaaagcctgcttcttccagccagaggtctgagaaaatggtggtctaacagaacaggaaacacttttgatgttttctcatgctcaggccaaaccaaaatgatacaatcctgtggttccatggaggctgagcagggagctaatgttccctgccgtagatacacaggatctgcatgctcttatatgttttcttccatgagccatgaagaatcctgagaaagttccattcttaggatatgctgggagacggtcacagcagccactaccaaaattctgcctagaaccaaattattatctaatttatggaacaaatgtcttaatctgcaagggcaagaatataataagttgttttagggcactgacaggaactcatagcagctatgggaaggaaacaagaaaaaaagaagcacagaagtaagaggagaggcaggaatacacagtagacccaatactcaagcagaagagataagataaagtagcacttgcaataaccatggcttcaaacctgaagacacaatgcattcaacagctgaattcacattcttctgaaatgcacatggaacaatcatcaaaacagactatattctagactgtaagacaaaccttcagaaatatagaagaaataaattatacagaggatgatcttgggccacagagaaattataccagaaatcagtaaacacaaatttatctggagaaatacaaaagaactgtaagttatacattcctaattaacccatgggtgaaagaattctcaaatgagatattttgaagtgaatgtaaacaaaacaacttagaatacagaaatttgtggatgcagctaaggcagtacacatagataaatttggggcttaaatttttttggccagatgcggtggctcacgcctgtaatcccatcactttgagaggctgaggtgtgtggatcacaaggtcaggagtttgagaccagcctgaccaacatggtgaaaccccttctctactaaaaatacaaaagttagccgagtgtggtggtgcacacctgtaatcccagctactcaggaggctggggcaggagaattgcttgaactcgggatgtggaggtgcagtgagccacggtactccagcctgggtgacagagtgagactctgtctttaaaaaaattatatttgaaaagaaagatctccagtcagatgcttgtttcccccttaggaaactagataaagacaggacattaagttgaaagaaagtagaaggatgacaaaaaagtcaaaccaaaagcttaattttttaaaaagtttttttaatgataaaaaccatcagagagaaaaaaagagaagacacaaattaccaataccaaaaattcaagagaggactaactactaacagacattcaagagataataaaacaacattaacaataactctgtcttagttcgggctactacaacaaattaccatagactaaatggcttaaagaataaacatttatttttcccagtgcaggagactggaagtctgagattagggtgccaacatgactgtgttcttgtgaagacctcttctggtttacagaccactcacttcttgttatatccttacatggtgaaaagtgaagtagctagctctgacaccgttttgtaacagcattctagtctctctctcttttttttttttaactataaaagcaaactaactttatttggacaatctaagtggaaagaagaggcaggtgaatgtgtattgtaaccacagggaatatattctatgtcaaatgttaaaacataatggcagaataatctaaaagacatttttttctaaaggagctgtcggtgaaaaggatatttacgacaacatattaacttacttcattatgatggaggatatgttaactgaatgtctaatttactcaaattttaactatgtttgcatatgtaaataaggcttaagaatgtaatgaaatcttcctctatatatgtgtatgtgtgtgtgtgtgtgtgtgtgtgtgtgcaattccaaagaacaacttctggaccaaatagttttaactagtaaattttaccaaatatccaaggaagaaataataccaatcctacacaatgtcttctagaaaataaaagatggaatatttcccaaatcattttataaggcctgcctcatcctcatagcaagattaggcaaatactattcaagaaaagaaactttcagaccaatatctcccataacataaatgcaaaaatgtcccaaaaagtacaccgaaatatataaacatagataatgtatcagtgaaatttacctcaaaaatgccaaacagttactacactgcaatactataaaaactatagtttttatgctgcatttcaggtcaatgtaatctcctatcattagtctgaagaactaaaatcacacactacatcaatgccaaaaattttaacaaaattcaaaatccatttgttaatttaataaaagtaatctataaaaagcctatcactaacattatactcaagagagactgaatgtcttccctctaagatcaggaaaaagacaaagatgcccactaccagtagctttacacaagattgcactggaaggaccagccagtgcaaaaaggtaagaataaaaacacaaagatacagagtaaatttacacagaaaatttaaaatcaaaaaagttccttgaactaataagtgtttttagcaagggcagaatctaaggccaatatacaaatctatgcctacaaacatacaatgatgaattggaattttaaatcacagaaacaatattacagcaccaaaacaaaattaaaaacaaaaattaaaaaagcctcgttatctgtgttctaaaaactaaaagacattgatgaaagaaatcaaagaaacagtaaataaatcagtagggatattttgtgtatggactggaagactgtacattgttaagatgtcaattctcctaagttctgcagattcaatgccactccagtttaaatgccaacatgtttcctttgtaaagattatgaacctcatttaaaaatttatacacaagatgaaaactggagaagtacttgacttcaaaacttaataagctagagtaatcaagttaatgtggtattggcataaggaaagacatgtagatgaatgaaaaggaatataaactacaaaaatagacccccaaatgtacagccatctgttttctaagaaaggtggaaatgctgttcagtggagaagtaacagtcttttcaaaaagtgatgctggaataactggactccctgttccaaaaacatttaacttgacacataactcatactttctatagaatttaacacaaaatggattatcaactaagtgtaaaaactgaagctgtaaaatttctagaagaaaataggattcctaaatctgttactttgagtttcaaggtttctagatagaacaacaaaagcaggttctgtaaaagaaaacaagtaagttggactttatcaaaattaatattcagttttagtgagcctcctctaaagttatactagcgggagtgaggtgcagcatcactgcctgctacgtggggaaggaagtccagttccccactgatctgacgccctgggggtggaagaggaggcttctactttttttttttttttccttccttttgagacagtttctctcgtcgcccaggctggaatggagtggcgcaatcttggctcactgcaacctctgcctcccgagttcaagcgattctcctgcctcagcctcctgagtagctgggattacaggcacctgccaccacgcctggctaatttttgtacttttagtagagacggggttttgcaacgttggtcaggctggtctcgaactcctgacctcaggtgatccacccgcctcggcctcccaaaatgctaggattacaggtgtgagccaccgtgcctagctgaggcttctacattaaccctgggcatgggtgaaagatcaggagccccacaaggactctgataacactaaccaccttgtattttgtcaggtgccaagacccctagtgcatcttcattcttctttccacccttcagtagtgtgatctcagctcaccataacctccacctcccagattcaagcaattctcgtgcctcagtctcccaagcagctgggattacaggcacgagccaccatgattggctaatttttttgtatttttagtagagacagggttttgccatgttggctaggctcgttaaactcctggcctcaagtggtctgcctgcctcggcctcccaaggttctgagattacaagtgtgagccactgtgcctggctagatattgcattctttacaaactgaaggtttgtggcaaacctgagttgggcaagtctgttggtgccatttttccaacagcaagtgctcactttgtgtttgactcagcagtttttagcaaacaaatattttaattaaggcatgcatactgttttttagacatgttattgcacatctaaaagactaaagtatagtgtaaacataaaacttttataagccctaggaaaacaaacattgtgtgtaacttgctttattgtgaaatttgcttcattgtagtggtctggaacagaaactgcaatatctctgaggcatgcttctatatacagatatttagctgcacttagtgggtagagtagaaaggaatacatttactccatccttcccctgggtaatgcattctgtattttattaaatccttccctaagaagagtcattaacctattctatatgatcttctagaatatttctacttttgttttgataattaggtcttaagccaactgaattcgactttttgttttgttttgatctatatggatacctcaagatcctttcctcattgttctccagtgtcatctatctaagatgtctatcaagtatatgttttttcttttctcttttttttttttttttttttgagatggggtcttgctctgtcgcccaggctggagtgcagtggtgcaatctcggctcaatgcaagctctgcctcctgggttcacgccattctcctgcctcagcttcccaagtagctgggactacaggcacctgccatcacgcctggctgatttttttgtattttcagtagagacgggtctccatctcctgaccttgtgatccacccaccttggcctcccaaagtgctgggattacaggcatgagccaccacgcctggcctcatgtttttttctttaactttctactctgtttcactaatttactaaatcatcccaccccccagctccatgctacttagctacacagcactttacataaagcctcaatatctggtagagcagcaaatcctcctgtatcactcgtttttatgaatgggattgtgtttggtatagcgttacctctttacagatgtatcctgacttgaatttattatataggtgtttcctctcttttttctttgatagagttagctgaagtttaattcattttatttttcttgtaagaaacattccatttctgttttccattttatttttaattttacttttaaattcttctgttttcactattgtatttttgatgctgttcttgcttaattaatgagactacgaacttccttctgtccactactttagctatacctgatggtttctaacttgcagttacaattatttcattacagaaatcaaatccaaaattgcattacacttttttgtatattgtttaaaagagatactaaaattttttcaagtggatttttttcattttattattaatttctagatttatcaaactaggttcagagaatactgtttgtgtttattctaatttgttagatttattgaggttttctctttagactaatagtatactctattttatcattattcaattaaaacatgaaagttttgttttttgcattagcatacatatacacaaatgtatggttcactttaatacaaatgtaatttatagcctctctaggcatatttatttaatgtccactgtacctactgtttaatcagatgagacattatgatgtcctaattctaatgagttttaagttcttagaactccattattttatgttttagaaacattgatattatattatttggtgcactcattcaaatccttaaaggttttcatttccctgtgctcttgaatgagagcttttcctactttaatgaatttcttgcctgaattcaaatctgaatgatatagaacatgaaacctacattattttatctttattgactcaacaactttactgatttttttttttttttaattttttgggactgagtctcgctcttttgcccaggccggagtgcagtggtgctatctcggctcactgcaagctctgcctcctgggttcacaccattctcctgcctcagcctcccaagtagctgagactacaggcgcctggctaattttctgtatttttagtagagacagggtttcaccgtgttagccaggatggtctccatctcctgacctcgtgatccgtctgccttggcctcccaaagtgctgggattacaggcatgagccaccacgcctggcccaactttactgatcttttataatgatctttctatgttacttatttagggatatcctttttagacaatcaatatgatccaataatttacatttagtgactcagcaacatacttgatctaaattatgtcactctttatgtgatgctatttgttggtatggcttcaaacaaaaaccttaattgtgcttcacttctaataagatgattttacttttttattctaaaaatgacattgaaaactataactttttaagatttctggaatcatttatttgtacaaagcctaataggcatataaaaagatgcctgatatcattagtgaccagggaaattgttatagacttgtttgtgtccttcccaaattcttatcttgaagccctaacccccagtgtaactgtatttgcagacaaggccttcaaggaggcaaaaagggtaaaaatgaggtcacaggaaaggaccctaatccagtagtactgatatctttataagaagcggaagaaacaccagagtattctctctctcccactgcatgtgcacagaggaaaggccacatgaacacacagcaagaaagtggctgtcttcaagccaggaagagacgcttcaccagaaaccaacttattagtactttcattttggactcccagcctccagaatcatgagaatttctgttgtttaaactacccagcctatggtattttattatgatagccctagctgactaatacagaaatgtacatcaaaaccacagtgagatatcagttcacatccactggggtggctagaatcaaaaagtcaaacaataacaagcattggtgaggatgtggagaaatcagaacccccatatgctgttgttaggaacagaaaaatgctgcatttagaaaaaccgtctggtggttcctcaaacagataaagacacagataccatatgacccagcagtttcactcctaggaatatacacaagagaaataaaaccaattgtccatgcagaaacctgtaaataaatgtttatattagcattatttgtaggtggaatcccaaatatctactgactgataaatggacaaacaggtggtacatccatacaacgggacattatttggccataaaaagaatgaaacatgtattttatatcagttgtaaacattatgctaggcaaaataaaccaatcacaaaagaccacatatatgatccaatttatacaaaatgtctaaaataggcatatttatagacacagaagtagactgtggttacctagggctgcagagggcaggggggatgggacagtgataactaaagggtacacgtatgtttgaggtgatgaaaattaactgtggtgatgtctgcatatacagtcatcccctggtatccatggggaattggttccaggattctcttaaataccaaaatccacaaatgcccaagtccttgatacaaaatggcatagtatttgcatataacctatgcacatcctcttgcatactttaaatcatcaccatattaattatgctacctaatacaatgtaaatgccatgtacatagttgttatactatattgttcagggaatagtgacaggaaaaaaatgtctatacatggtgaatgaaagtgcaatatttcttccctgaatagttttgatctgtggttgcttgaagtcactgacctgtacactttaaaggagtgaattgtaggcatgtgaattatatctcaataaagctgttccaaaaaaactttcaaaggtgctctccctctaaagactaagtacccccaggtacttctgttaatgcccactcacctgggtacctctggttcaggaattcatcttctaaagaccatggctcttctcctttctccaacttggagatcaccttgggtttagtaatgcaatatcctgtaaacaaaataattgacatggaccagattcacaggcttttggatttccaaagggaaaaaaaagatatggcagcaaagcattaactgagggtgttcatttgaaatttttaatgggaaagtaatgacatgttgcttttgtttctgtaaaggtttcaactacttcagaccttttaatccaaagccctttaatctctataaagggtccatgtgttttgatagtttttaaaaagggacatgtattctcgagagagccccatggtaagctatgctcacccactgagacgaggtggctgtagttctccagcatcacatctctgtacagcgtcctctcgacagggcccaggtgctgccactcctcccgggtgaattctacagtcacgtcctggaatgacactgatgcctgtaacaacatttatcacaacaaatataacaacggtttgttcaagggttcagaattgggtgacacagaaaatatctttgagagctactactaaaatgaatggttataaaggcctattttagacccaaaattgtcttaacatatgtaactcaaaacattttttaacttgccataatttctctatgtatttatgaattctaggtttttgtaagacaaaaaaaaatcaatgtaaaacaacttccttccaaccacctccttccttcttccacatctccgcaaattatccggggtagtctctaggacattcacaccctccctggacatcatcactgtaaattctgggggctaaggaagagatatatgtgaagtctggagataccctgaccaaactttatatagggtagagcaggtgaagagcagagaacagctacaatagttgtaaccaaagagactggcacaaaagaacactttctacactgaggtcacagcaatggatgtaagaatagggatataatcacagaagagaagcaacacccatttaatacaatactttattgtacagctactcaatctagctgtatgagaagctccttttaaaaaaattttgtttttaattgacagaaagacaaatatttcaaattatagtcacttatatgtggaacctaaaaagttcaaactcatagatgtagacagtagaatggtggttaccagaggctgggggtgaggggtgaggaatggggaagcattggtccaagggcacagagtttcagttacataagaggaatagtttttgagctattgcacaggatgatgactagagtgaaaaataaagtaatgtatatttcaaaataagcagctgcttggtggtgccaaaactggtatctgggaaagaagaaaacgtgttagaagattcagtgagagttctgttcatgttgatacgtagctagaactgttcgttcaaccaggatacatatgattttagaacacagaaggtaagatggggatgaagataagcatttaggatttactagcaatttaggtggtgagtaaaattagcagagacagacagctccttgagcacacagggattgaagaaagaaaagaaccaaaaacaacacctgaggaaccacaaagcagaaaaagtacaggccacaaagccagagatgttttccaaaaaataataacagaatcaggagggggcagagtcttagaaattgagaaaagagaaagtttccacaacaagaagacttcaaattcaaattagcaagtgatgacggtgaagatactgaagatccaagaaaattccttcttccataaaagcaacgagaaaccggcaaaaactgcagaatcaactttttcagaactctagaagctaccaaaggcttacagcaatctgcggaacattgatatgagaaaaacagctgcatcacagtaagaacaatgatcttgtgtcatttcaacctgccctatatccatccctctcactcccactcggcattagctttgagaaacatctgaaacaacaggagaatccagcggcctggtatccactggatgaggcagactgggtcacaggttggccaaagcctcactcccagaaaaccctcattatctgacctaatctgtggttccctggaagagctgacttgaaaggctgattgaattaagtcagagttccccagtgtgaaaagccttattcttgaaggcatttgccaaaaacattcaaaggcaattgtttaactcagcagctaactgaggcggtggataacacctgacataaataacagcctaattgaaaagctttttagaaaggaaaaactggagaatgggatgttcataaagcttttgaaaagctcctatagattctagagactctaggtcacctacatgcatagagctgagcatatgcccagggctgtgattatgctctggaaagatgtgagaaggccctaaactgtcaccctgggtgaccctagggtttggggtgaactggaagtgaaggaagtgaaggttaacatggggttataaattgcctggatgtctgttgaaggaatgccccagcactcatgaggctctttggcaaagactgagagccttacttaaggtttcaggcatttaagaaaatttctgcagacttctgcggccacacatgacaataaacacaggctctactgaatcaattaaaaagtcactagacaaatttcaacaacaactcctgcaaatcaagaaagttttctagagttgccaccgtatttaaaatgtatagttttcaacaaaaaatgcaaaacaagaaaagaaacaacaagtaagacccatatgcaggaaaaaagtacaatcaatagaaactactcacgaggaagcaggcattggacttaaacagacgatgactttaaatcaactatgttacatatggtcaaagacttagaggaaatgatatgtaaggaccaaaggaaagtattagaataatatctcaccagataaaggatataaatagacagaaactataaaaagggaccaaatagaaactctaaagttggaaagtacaaaactaaaacaaatattttaccaaaaacacctgttcaacagcaggtctgaacgggtagaatgaagcaactggacaacatgcccactgagattatgcagtgagaaacagaaggaaaaataacaagaaatgaacagttggacagcatcaagcttatcaacatatgccaaatagactaacagaatggagacagaaagggtctaaaacaatatcagaagtagtaatggccaaaaaaccccacaaatctgaaataaatgataaatctacatgcccaaaatgcttcacaaactttaagtaggataaacttggagaaagaaatccacactcgctgggagcagtggctcacacctgtaatctcaacactttaggaggtaggcagatcacttgaggccaagagttcaagaccagcctggccaacatggtaaaaccccatctctactaaaaatactaaaattaaccagacatggtggtgaatgtctggaatcccagctacttaggaggctgaggcacaaggattgcttgaacccagaaggtggaggttacaatgagccgagatcatgccactgcactccagcctgggtgacagagcgagagactgtctctcaaaaaaaaaaaaaaaaaaaaaagaaagaaagaaaagaaaaagagaaaagaaaaaagaaaagagaaatccacacctggacatgagaatcagagtgttaaaaagacagacaatcggaaagctgtaacagagaaacaagtcatcgtattacaggctgatttataatgagaaactatggaggacagagggcaatgggatgacatattcaaagtgctgaaacaaagactgtcaaccaataacctctatatccaggaaaaatagagaaactggaattttcccaggtaaacaaaacctgagagaattcatcacaggcaagactgcctataagaaataataaagggagtggttcagcaaaactatggagatagaggagtaggttagtggttgtttggggctcagagggaatcaaatggtagttacagtgtacacagcttctttctaagggaataaaaatgttctaaaattgactgcagtgatattagcacattatctgagaatgtactaaaaaaaatcactgaattctacactttaaatgggtacatggtaagatacatgaattgaatctcaaaaaaaagcagttttaaaaaaagaaaaaaacaagggaagacaaaatcatttggagacaacagagaagactaaagagccaaggacagaaactgaggctgagccgagtgacaggacaaggaaggtggctccatgaagacatcagccggggaaggaccagtgaggggcaagtatcactaacggaaatgttccaggacagagtgagacattgaggcaagtgctgcggaaaagccaagcaagttaaggaaaagaccacgtccactggatttgattatactatgggtagggacactggaggtcccaggcaagtggcaagaaaaaatcaaggcatcccatggagagttgacgttaaatgctaagtgtggaaatatctgaaagagaacaattttggaccatctgctgagcaacctgaatatcatgggtactcaaaatatttatggagagtgattttaaagacattcagttgattcatcagaaaaatgttaaattcaacccttgcactggagtacttgaaaaatagtactgaacgtgttcaaatttagcattacaatttctacttctattgaagaagtaatattctgttatttggcaatttattaactaagtcacctacttgaagaacaataaatacattttgttatctttatgtttatattccatgataaatcagttggctttatctttctcatcaatgtaaacctttaagtattgtctgtctgacactccaccatgactgtcaataacctcagaaataaatctgaagcttaatttggtaaatttgtaacatcggaggatctgcatctatccacatgccactttgctctgctattcatctgcatttctacatcttctaggaatgtgtctgatccatctctatttctacttttccatgttaatgtacggacacataaacccttacaaaacctattgtaaaataaactggtttttaaaaacctaactcacctgagacatgttcattttctgctgctcctggaagagtgtagaggactgtggaggttcagctggggaggaggaaagagcagtggggtcatgagagacctggtctgcctctcagttcttacagagatggtccctgacatgagatggttcgacttgataatggttttactgcgacataaccccactgtaatcaaggagcatgtaatcctattcatgtgcctaaaaaaaaaatcatcgcactcagctggagaaaaggattcccaatgcagaatgtccctttgactcttgaaaagggacaagaaagaccactcaaagatagccacacctgaatatgtgcatctctgatacgattatgtgcgcttaaacttacattttcactgagtaaagtaatactgttttttgttgatttactaataattatgttgatttattaacaattatgttcccttttgactaagaaaaaagtaaaaataaaacaaaggattaagcaagttcaggtacacagagatgaagctgtttaccttcattaaagctaatgtcaaagaactattcagccgggtgtggtggatcatgcctgtaatcccagcagtttgggaggccgaggggggtgaactgctggaggccaagagttcaagaccagcctggtcaacatggcgaaatcctgtctctactaaaaatagaaaaaaatataaaataaataaattttaaaataatttttttaaaaaagaactactcaggctgacttaatcaagttcttactgcctttacacccagaattagcacttccacggaaaaaataaagataggatgttttatgcaaggaatttcaggcccaatatttttgggcttccaatataggaaattcttcctctactacccggaaagaggcagcattagtatcactctaaatgccacatgtggtgatgaacacggtgtgagagggactcacaatgtggaagaagtgaaggcagaaaggaaactaggctgccgtttgggatctggacagctgattacatcttccctggatatcatgacctaaccagccctccagtaaagtgtctttttccacccagcttgatagtcactcatccctctcaacccctgggaattgccttctgcaagttagtccacagcaaagtcacacggtctgtgatggcttctggatgtggcaacatcacgaaatctgatgcatatataaggagtcaacaactgcctctggggaagcaatcaggacctgctcctttctagaatcttctgcctctgctctgacgctctagaagaggtctccgtcatatgggctgttcttctatggcagtaggccctaggactccctcttgactgcctcataggagctgctttgctccagaggggctgggacttaggcctgagaaacaaactcaattgaaaccttcacctaataccctaaacctgactcttgagattcactagaaatgtgctatccagcactgcagccatcagccacatagaaccattgaacacctgaagtttggccagtgctacaagtcgaatatttaggaagtaaaataaagcagtaaaactgactttgtctgcctcttctttttactgtagctactgaaaaattctaaacttttttttcttttttgagacagagtctcactctgtcactcaggctggagtgcagtggtgcaatctcggctcactgcagcctccgcctcgggttcgagcgattctcctgcctcagcctcccaagtagctgggattacaggagtgcaccaccacgcccggctaatttttttatttttgtagagatgggcttttgccatgatggccaggctggtctcgaactcctggcctcaagtgatccactggcctaggcctcccaaagtgctgggattacaggcatgagccaccgcgcctggccaaaaattctgatttatatttgtgttttgccttatctttctattggacagcacagcaccagaatatcaatctgtgcctttgaggagacagcgggaacagtacaagaggattcaggagcctcagcctgaatcagagacccgacaaatcgcagaatgtatctaccacttggtgagattctgtccacatttacttcacaatcatctacacagatctggtgacaggccactctgcataagcgctctgaaggctttaggcaggtactggcaagtctgggtttcaggcagacagcatgttagaacgagcaggacagggagtcctgcatttgcatctctcagcatttgcatctcacctctctcacctactagtgtgtgccctggggtacccatccccatgaactttcgtccatttttttaaaatggcacgtttataccaaagaggtcgttgtgagggtcaggtgaaataccaaacgatgagaataagtgtctcataattgtgagagcagcttacatttcacatagtgactattacagacacttaacaaaatgctttacaggtgacaacttatttaattttcagaataggaacacgagttgctagtaacctcctcctgttcgccgtcaacctcatccacgcacattcctcttcccggcccgcaaccccgcggggcccggcagcccctacacctgcggacaggactcggcctgggcccgcgcactgggccggggaggagaggggagggccatcctggggactcctgagactgcctgctgctgtcctccgcacacaagcccgcccgtccccaggttcctgggccgcgcggagccctgtcaccgacgctctcaccccaggtgcgcagcctgggctcccgcgcagacctaaagactcggacaccgtgtccctttcaggcccgggagggcagacggcaggaggtggggctgggtttacacatgcgcagagcgagccccgaagccccattcccaaagtgctgcgcggtaggcgcgttaacattgaaaactacagttcccgtaagcccgtgcgtccgaaggaagtactataattttttctgctgctttgaccggctgggagggaccttcggagcccagggatttcccaaattcccggaggttgtcagcatgaccacaaactgcgaagcgtggttcttgatgcgatcctggttggagaaaaaagcacctgaaacagacattaacaattggggaaacatgactatcgacaggacattagaaatattaaagaaaattaccgttactttgagaataatagctagacgatgtaggacattgttcttatatttaaaagatatgtacagaaacatttacaattgtatgcttgtagtttaattgaaatactttaaaaatttctcaaaacaatgaaagcagatatagtaataagtgaagaattgttaaatctgtataatacgtgcttatgatgctcattttactattttctaccattctgagggtctgattttttttttttttcatactcagtaaaagacgtgtggggcagtgcagtgcagggggagtggagaggctttactatcccttcggaagtatgccgttaaattcaaagttgccaagggaagtaaaagtacataaaaatagctttatgaataaggttgtgaaatcgaacaaatactagaaaacataaacgagtaacatctgtgatcagcagggtttatgggggttggaggaggaagctagctgttcaaaatacatatgtgatgcgtgaaaacacatgcaacccaaaatatgaaaatgattattacaccaaccttgcattttcatgaggaaaccttttttgaaacgtgtatacccatctgactgtttaaagaattaggaatagataggtactataacttttttttaatttttaattgatagacttttcttattttattttattttattttatttttttgagatgggttttgctctgccgcccaggctggagtgcagtggcgctgtctcggcccactgcaacctccgtctccgggctcaagctactctcccacttcagcctcctgagtagctgagactgcaggtgtgggccaccatgcctggctaatttttttttttctttcgagacggattttcactcttgttgcctaggctgcagtgcaattctcggctcaccacaacctccgccccctgggttcaaacgattccctgcctcagcctcccaagtagctgggattacaggcatgtgccaccacgcccagataattttttgcatttttagtagagacagggtttcaccatgttggccaagctggtctcaaactcctgaacttaggtaatccaccttgcctcggcctcccaaagtgctgggattacaggcgtgggccactgtgcctggccttttgtattttttttttgtagagatggggtttcactatgttgcccaggctggtctcaaactactggggtcaagcgatctgtccacctcagcctcccaaagtgctgggatattaatagatgtacagagcagttttaggtatacagaaatattgagcagaaagcacagagttcccatatacctccgctcatcaacccacacacagtttcccctattattaatatattgcattagtttagtacatttaaaatacatagtttatattagctttcattctgtctgttctacagttctgagttttgccaaatgcatgtcttttagtgcgatttccaccaatgcaatgatgtaatatccaccattacagtatcataaaaaatagtttcactgcctgatatggtttggatttgtgtccccgcccaaatctcatgtcaaattaaaggaggggcctgatgggaggcgattggatcatggaacagatttcccccttgctgttctggtgatagtggattctcacaagatctgatggtttaaaagtgtgtggcacttcccccttcgttctctcttttgctttgccatggtaaagatgtgattgcttccccttcactttctggcatgattgttagtttcctgaggcctcccagtcatgcttcctggtaagcctacagaactatgagtcaattaaacctcttttcatcataaattaccccatctcaggtagctgtttatagcagtgtgagaatggattaatacagaatttggaaccaggagtggggtactgctataaagatacctgaaaatgtggaagcaactttggagcataactttttttatttcacattgtgccagcaacatttgtagaaaaggctatcttttctccactgtattgcctttgttcttttgtcaaagatcagttgctgatacttgtgtaggtctttttctgggttctctattttgttccattgatctattaatacttgtcagttatttcaccaacatgacactgccttgatcactgtagctttatagtaatttttgaagccaggtggtattagtcttctgactttttcttcaatattgagttgactatctgggtcttttgcatttccatataaactttagaatcattttgttgatgtctacaaaataacttgctgatattttattgagattgtgttgaatctattgatcaagttggtaggaactaacatcttaacaatattgaatcttcctatccattaacatggaatatctctccatttatttagttatttctttctttcatctgagttttgtacttttcctcatatagatcttgcatgcatattgttagatttatacctaagtatttcattgttttaatgataatataaattgtgtgttttaaatttcaaattccaattttcattgttggcttataggaatgtaattgacttttgtataataagcttgtatgctgcaatcttgctaataatcacttagttccagatgtttgtctgtcaactctggggtttcctacagggacaatcatatcatttgcaaacaaagatagttttatttcttccttccctatctgtaggctttttacttcattttcgtgttttgttccattagctaggactttcagtatgatgttgaataggtgtggtgagaggggacatccttcccttgattactatcttaggggcattttctttctcagcatttaactatgatgtcagctatgagttttctgtaaatgttatttatcaagttgaggagcttccctctattccttgtttgctgagagtatttatcataaatggggattggattttgtccaatgcattttctgtgtttattgatatgattgtatgatttttttctttaaccagttgacaagatggattagattaatttattttctttttccttttttttttttttgagatggagtctcattctgttaaccaggctggagtacagtggcgtgatcttggctcactgcaacctctgccttccgggttcaagtgattcgcctgcctcagcctcctgagtagctgggactacagatgcacaccaccatgcccagctaatttttgtatttttagtagagacgggatttcaccatgttggtcaggctggtctcaaactcctgacctcgtgatctgcctgccttggcctcccaaaatgctgggattacaggtgtgagccaccatgcccaggccagattaattgattttctatgttgaaacagctgtgcatacatacctgagataaatccaaattatggtatataattccttttaaatattgttgaattctatttgctaatattttgttgagggattttgcttccatattcatgagaaacattggtctattgttttcttatcttttaatatgtttgtctgattttaatcttaggccactgctggcttatagaattagttagaaagcatcccctctattttactgaaaagattgtagagaatttctgtcttaatgtttggcagaattcaccagtgaaactatattggcttggagctttttataaaaagttattaattattaattccatttctttaatagatataggcctactgaagtagtctatttcttatttgtgtgagttttggtatatttgtcttctaaggaattggtccatttcatctatgttatagaatttgtgggcacagagttgttcattggatgtgaaattctaagttgacaaatttttttctgtcaacactaaaaattttttttttttttttttgagacagaatcttgctctgttgcccaggctggagtgcagtggcacgatcttggctcactgcaagctccacctcccgggttcacaccattctcctgcctcagcctcccgagtagctgggactacaggcgtccgccaccatgcctggctaatttttttttgtatttttagtagagacggggtttcactgtgttagccaggatggtctcaatcccctgacctcatgatccacccaccttggcctcccaaagtgctgggactacagccgtgatccacggccaacactaaatatttcactccactgtcactcgcctgctttctgaagagaagtctgatgtggttgctactctgtttcacaacatgtaacatcccctcccccgacccacctcctttcaagattttctctttgttttttatttttctacagtttgaatatgatatgtttaggtgtatgttatctgatatttatcctgataagtgttctcttagtttcctggtctatagtttggtgcctgttattaattttcaaaaattatcagccattattacttcaactatttcttatcttcatttttcctctctttttggtattcccattatatgtatgttacttttgtaattatctcaccttcttggatattctgttctgtttttaaaaaatcttttatctctttgcatttaacgtttggcagtatatattgacatatctttgagctcacagagtctttctcagttatatgccatctactgatgagcacatgaaagcagtcttcatttttgtttcatcgtttttgaattgtaacatttacttttgaatctttcttagagcttacatctccctgtttacattatccatcagttcttgcatggtattcgctttttccattatagcccttagcatattaatcagagtcattttacatttcaagtctggtaattccaaaacctctgccaattctgagtccagttctgatgcttgctttgtttcttcagattgtgttatttttgccttttaatgcactgcaatttttattggaagccgaatactatgtatcagataaaaggaactgcagtagatagatctttaatgtaaagtttaatgtttatctggctaagagttaaactgtgtttcctgtttgtggtagctgtgaagtcaaaagcaaaagtttcctctagtgtccttgtttctgtctcccatcttgtctttgggtgttcatagactccagaaatagggtctgagcctgcagttcttttaactgtaattccaggctatcatgcaggagctctactgatgcagtagtaatgagtgtgaggagggcaagccttctataatcctctgattagatcccagtcttttagtgaactgaagttatgtatttcttttcctccgtgttaaagtctgaagggggctggggttggggattgccttccccaggtcacttaggttttcataaaaatcctttaggctgggttctggtaaagtagttcccctgagtgtgggccttgttaaggggagcagagagctctgagcacgtctcaaaaatggttacttttcccctccaccctgagaaaaatcatcaaaggaattttctctgatctccatactgagaacctggtagggatcttgcaagtaaaactctgcgaagtgttggggctgcctccaagaccaggtttcttctgagttcttaactctaaatttagtccacattgagcctctagcaatttacgaattacagtttaaaatgttgctacccgtactgctgtggacatctccctctgggaatctgctcctggtaagctgtgattctctgtatctgcctgtctgtttctccagttgtcctgataacagtttgtcccatgatctcaattctctactcgagctaagaagagttgttagttttcagtttgttcaaccttattattgcagaagataagaataatgacttccaaactcattgcatgtcagaccagaaaccaaagtctgtttattgtgttttgaattgcattgctttatgctgtaagaacaggtctttgtgaagttcagtcagacttgcttccaggcttctactttattccatgaagtatcttatcaaagaatttaagctaattgagtctgtgaccatccatagtagcactactcacctctgttattatctttcttttttctcatagttctctcactacacaaagtatcctaagtatgttgactacaacaaaatggcaacttcctgaggacagggagcttgtctttgtctcactgagcatatatgtgctcaaatatttcttgagaaaggaacaaggacctaaatctgctagatactaccaggcagtggatttctggtaattaacaagacattacctaccttcccctagcttagcatctagaggtggagatgataaggactatgatgagagacaacagagcagaagacaaggacaggaattctcatagttggcaggcgcttctctgaagaggtaacactgacactcacgctcaaaaggtgggagggaagagatcatgtgcagaatagaatggagggtaagcccccactcaggaaaaccagcgctcactatgggaaagattttatcccatttgaggaagacataaaagtcaagtgcagacacttgaagccattaagaatgttcctttggctttactctgagaagtgcctaccacaagccaggctagcaaacaccttctcttttgtctgagctagactgtcaagcaaacctcagtgatgaagaaggcaaagtgatatgggtcctttcctttttttaaagtaattatttcttattcaaatcaagaagttaatttgtgaaaatgtccgtcactcccaggccaactagaccaagacaagagtaatcagagcaatggagagtgcgactgagagagaataagaatgactatccctttacaaacccaccagaatggctgcttacgaatctggctggctagaataactattttctttttctttctatttttttgagacagtctcgctctgttgcccgggctggagtgcagtggcatgatcttggctcactgcaagctccacatcctgggttcacaccattctcctgcctcagcctcccaagtagctgggactacaggcacccgccaccgtgcccggctaattttttgtatttttagtagagacggggtttcaccgtgttagccaggatggtctcgatctcctgacctcgtgatccacctgcctcggtctcccaaagtgctgggattacaggcatgagccaccgcgccgggcctagaataactattttcttgttattctgaagctactttgggttcttttctcagttcacaaatattacacacatttttcaaatagcagagattcttaaatattctgaatttgaagccatatcacccgacgctcattcaaactgcatgaaactgattatcattaaaaaatcatgactattattaaaagtgatgcagtacaaactgttttagggtaacagagttaaagaggaaaaggccttctttgtaggaaaaaatagagttaataatttcacaaggattaaaagactatcaccaccgtgcaacctgaaataatggttgtaggcaatattcatcagcggctgctaaatccattcatgatagcttagtaagaatttcttgagataaaataacataaaatttatcattaactaaagtttatcattttaaccaattttaagtgtacagttcagtggaattaagaatattcacatggatgtgcaaccatccccaccatccatctccaaaattttttcatcttccctaattgaaaatctgtacccattaaaaaacataacttcctcttccttcccccgcctaccccctgacaaccacctttctaatttctgtatctatgggtgtgattactttagataccccatataagtgaaatcatacaatatctgtcctttatgactggattatttcattcccttagcataatgtcttcagagttcactcatgttatagcaactatcagaatttcattctattttaaggctgaatatgcaccattgcatgtatataccatatttcatttatctattcatccattaatggacacttgggttacttccacatgctagctgttgtgaataatgctgttaggaacacgagaatataaatatctgttcaagtccctgctttcaatttctttagatatattcccacaagtgccatttctgggtcatatggtaattctctgtttaatttttgagaagctgctacgctgtttcccacagcagctatagcattccagcaatatgcaagcattcaaatttttcttcatcctgaccaacacttgtttttttttttaaataataaccattctaatcagtgtgaagtcgtatctcgcaattttgatttgtatttccctcatgactggtgatgttggctatcttttcatgtgtctgtaagccatttgtatatcttctttggggaaatgtctctattcatgtcctttgcacatcttcaagctagattgtttctttttgttgtcacattgtagcaattatttatatattctagatattaatcccttatcagatatgtgattagcaaacattttctcccagtctgtgtattaccttttcactctactgagactgttttgatgcacaaaagttactaattttgataaattccaatgtatctatttttcttttgctgcctgtacattttatgtcagatctagagaaccattgccaaatccagtgttgtgaagagtttcctccattgtgttctaaagttgcagagttttagcacttaacgtttaggtctctgatccattttgagttaatttttgtatatggtgtaaggtaagggtcagctcattcatttgcatatagatatctacttttccagcaccattttgctgcttctaggataggtagattcattttaaattatcaaatttggaaagtttcagtcattttctttccctcctttttttctcagtgtgcatacattagtatgtctgatgatgcctcacaggtctctcaagctctgttcattattgtttattcttttttctttctgtttctccaactgaagaatttcaaatgacttatcttcaagattgttaattctaccttctgcctgctcaaatgtattgttgaaagcctctggtgaccttttcatcttgcatattgtacatttcatttcctaaatttttattttgttccttttatgtttccacttccctgatgatattttctagtttttatacattgcattctgctttccttttgttacttttccatggtttcctttaagatctttgagcatctataggacatttgatttaaagtttttgtctataaagttcaatgtctgttcttgctcaaggatactttctcttttctcttttcctgtaaattagccatttttttcttatgtctttgcatgacttagaatattttgttgaaaactggacattttaaatgttataatgtggtcactctgaaaatacgtttttctcttttaaagttctgttactgttgttcaccatggtttgtagttgcttatttgtatactgacttttataaaccagttttttaaagactgtattctttgtttttcatggcacctgctatggtatatgtcttccctcaaaattcctatgttggaatcctaaccgccaaggtaatggtgtgaagaggtgaggccttgggaaatgattagatcttgagagctgatacttcatgattgggattaatgtccttataaaagaaacttcagagagttgagtagccccttccatcatgtagggacacggtgagaaggcactgtctatgaaagggcaggctggcaccttgatcttggactttctaacctccagaactgtaagaaataaatttctgctgtttattaactacccagtttattgtattttgttacagaagcccaaatggactaagatagcctctgaagtttttgttcctttatcttgtggtcagctagtggtttgacagagatttccttaaacacatgtttcagttgcctctgttttggcgtagcatttgctcagttgctgtaaactgtgactatttttcagagttctgagaaagttgattctgacagattttgctctgtttttgtgtgtgtgtttctgtggaggatgagccctgatgctttctaccttaccattttccctggcatcactcaacagctctaagagctttcaagttttgacaattcttacaggatatctttccagtgtttgttctctgatgtctaatattggagagccatctctttttcttaaatattgataacacaaggccagtgaattcatactcaggttatgagggcctgcagtgcatacttacagggcagttttcttgaagaaaatatatttatgcccagatctcatagtttcctagaaacatacttttgctctttacggagcaagtatactccccaaagttgtgaataaaactgaaataaatggtttttttaattctttactcttttctaagatgttatcaagttgatggtcctctaaaaatgataaaaaaataaggtctcttaatcttttcttataaaataaaacttatatacacaagccttattacagattagatattttggtttctggcatattatccacagaataaagtgattccaagtgtatattttctatattttcttcatttggaaaagaaatatgttcagaaaaattctctttgggaaactggcattgaatgtacacaggtattttggcattttaaaatgtgatttttcaaaactcagtgggaaagagaaataaagggaagaaatagtgaatagagaacaatagtctttaagattaattctaggaatggaaaatcagataacatagtgaactaaacaagacatgtgaagagtaagtagaataaaaaggaaaatcagtgcacaaaaattgtcaggactttatcagagacagggtttagattagagagggataacagggtccagattctccaactgtcaagtaaaaattacattggtaggatactcattagtccatatacttccggttggacttctctctttaccattccactcatcatgaaaataaatttaggatgtcaaaagttacctatatttaaagaacagacttataacccaagctgtaatatccctatcacatcacagacataaatgcacaagcagaagtatgaaactggtgggagtaaaagtcattttccacttctctggattgggttcatcactctatcttggctccgttgtctatttatgatatcagtgttgttcaacagtgatcatcctcaccaccaaattacaattttcctctttcccatctgttcacttatttttgccaaaacagtcatttccctgatgcatcttcaactcattttccacctacttttcaagatatttagtttctattgattcaaagagccttagacatactccttagagtttttagttttgatttcttacaaaaattcttgtgtgtactctactgttatcatcctgctgctacccacattccaggcaacaatgttaggccagtcctgtaaaacctaatatggccccgaaatcactgcttaagatactagtagataaaagaattaagagacaacattcttaaaacaaaagttttacctcaattgcatggacatttggtgttcacactaccactctacaaatccatagtgtggtctgctttagtctagacaagctgttaatcccttttaaatgttttgtttccaaaaataattttatactgaaagcttgtcatacgtgtaccctgcatgccatcacaacacaaaaaaaaatgctggtgccctggatgtgattgtggccgtgagcaataaaatcctttgtctttgacccagaagtcttgtatctcctgccagaatccatgaaacttggcaagctaacatgttagcttgcagatagggtaaaatgtcatgccctttataattcttgactagaatcttacataatttccataattatctatttagttagagctctgtggcctgatgagagtcatgaaccacatgtaactatttgcctttattatttaatataacaacaaatcagttcctcagtcactttagccacatttaatgtgcccaatagctacttgtgtcaagtaactattgtgttgaaaatccaagtatagaccattcccattatttggagcaattttaacaggacaatgtttgtttaaacattatttagtaattcctatttcataaccaatgacaaaatcagtatgtttatctttcttttttttgagatggagtctcactctgtcgcccaggctggcgtgcagtggcacaatctcagctcactgcaagctctgcctcctgggttcatgccattcacctgcctcagcctcccgagtagctgggactacaggcgcccgcaaccacgcctggctaattttttgtatttttagtagagacgaggtttcaccgggttagccaggatggtttcaatctcctgacctcgtgatccacccgcctcggcctcccaaagtgctgggattacaggcatgagccaccatgcccggcctcagtatgtttatctttcaactcattcttcaacctccaattttagtttcctttatttctaagtttttatatttgtaatgttaattataattttactaattagtttgtcagctttaagtaatattgccggtgcctagttacattctgtaccttactttccaccttactctcccacattagatacatcatttctaaatttcccaaagtaaagttctgtaaaagcagagtcttgagagaaatgttttcaagtgcccacttctgattatctaggatttcctcctggatactttttgacggtaatcaatgacgcctggggcctttctgttcacacacttcctgtaataacaatggaggctgagggcggtggatcacctgaggtcaggagctcgagacaagcctggccatcatggcaaaaccccatctctaccaaaaaatacaaaaattagccaggcatggtggtgcatgcctgtggtcccagctactcaggaggctgaggcagaaggatctcttcagcccagggaggtggaggttgcagtgagccaggattgtgccattgcacttcagcctgggcgacagagcgagactgtcaaaaaaaaaaaaaaaaaaaaggaacaatggaggttctctttgctccaacttacctgaagatcacttcttgttttgtagtgcagtacaatttaaatgaaaaataatttagaatgtgggccagccacatggattttaatgcttctgaaggtagaagaaaagacaattttagatttggtcaaatgaaatcctcatattaacttcttttgggcaaaactgacaacaaaactattctttccattacctaaatgggatcaatcactgtagatgcccctgaatcataagcctaaatgacattaaactttaatgagtccattaaactttaataaaagttcaaacaatatactatctaaaagaaactatactattttgacagaaatacgttagaagtaaaagaatgcaaaaaattacaacatgaaaatactaaacataataaagttggagtcgctacttcaatatcaaataaaataaagttcagataaagcaatattaccaggcatgaagagaacactgcttaacaataaaggggacaattcagaaagagtacatcgaaatcctaaatatttatgcaccaaattacagaactttaaaatgccttaagcaaatctgtagtgcaaaaagaaaaaatagccaaacccacaattaaagggtagagatttcaacactcttttgtcaacaattgatagcaaaaataaacagaaatgtgtaagggaagagccccatcatggggtggctgtttttttttttttacagtctcactctgtcaccaggctggagtaaagtggcgcgatcttggctcactgcaacctccaccctccacctcccaggttcaagcaattctcctgcctcagtctcccgaatagctgggactacaggcaccctccaccacgcccagttaatttttgtatttttagtagagacgaggtttcgccatgttagccaggatggtgtccatctcccgacctcgtgatccgcccacctcggcctcccaaagtgctaggattacaggcgtaagccacatggtggcctttctgtatgtatccctataggacaagcaacaaagatttgaactgctggccaggcacggtggctcacacctgtaatcccagcactttgggaggccgaggcaggcagatcatgaggtcaggagatcgagaccatcctggccaacacggtgaaacctgtaatcccagcactttggactgcactccagcctgaatgacagagcgaaactccgtctcaaaaaaaaaaaaaaaaatggaactgcctctaatctgagtcttgccatagcagcttgcaattctcctggaacataagaaaaaggcttgggagaagctgcctcaataccatcacccatttgcctccctatccctcttaggaggttgttataagacagttgcttattacctgctggtatgtggaatgatgctttctgctctactcctacctagggtttagctacagaccataatgccctttactgtcatctagaatttgttcctcaggaatgtggtctcccacgagttatgttgcagttatctgaccctttttacattagtggtgcccttttaggcatgtggcacaagggctgggagctgtcacctttggctactctttctttcattgtctctgtaataaactccttgaatctataagcaacttggtgtgtctttctagaccaaatgacttcgttgttggccttgcctgctgtgtgtgcctgactccaccctacatgggccaatacagcttcaatgttcctctggaagatatggggccatgtggacaaggttggggataagatagattccctgcacaggttctcacctacatggtgggataaaaggggagggtgatacaagctctccaaacaaaggatgaaatggagcagtttaggagagataagactctccaagatttagtattagatgggattgcatgagacagattaggggatgacataaaaattgctgaaatctggttgcatatgctctctcctaagggtcaggcaaatcctattctacccatttagggcctgtatgggtcaagctagagaatattagaagactccctgggatctgatagcatatgctgtctgttgatacatgtttggagtcaggcagctggagatgggattgaaaccagctaccaacttgtgccttacatttaagtgtgttaagtatttctcttgacaaagaaaagcctggatcagagggctattctggtaaattctaacaaacattttaaagaaagatttacatcagactttctcaaacccttccaaaaagtggaggaggagagaacattctctgaagccagcattacccagataccattctttgaactcattctttgaagccagcattacccagataccaaggccagaaaaaggcagtatagaaaaagaaaactacagaccaatatcccttaggaatattgtcacaaaatcctcaagaaaatactagcaaactgatggccaggtgcagtggctcacgcctgtaatcccagtactttgggaggccgagatgggtggatcacgaggtcaggagttcaagaccagcctggccaatatggtgaaaccctgtctctactaaaaatataaaaagttagctgggtgtggtggcacaggcctgtagtcccagctacttgggaggctgaggcaggagaattgcttgaacccaggaggcagaggttgcagtgagctgagatcatgccactgcactcaagcctgggcaacagagtgagactctgtttcaaaaaaagaaaaaaaaaaaaaaaaagaaaatactagcaagctgaattaaaagaaggaaggaaaaaaaacatattaccatcccaattgattcaggaaaagcatttgaaaaaaatcaacatcctctcataattagaaaagaaaaaactcaataaactacaagtagaaggaaactttttcaacataataaacactatatatgtaagaaaactccctgctaccatcatacttgatgctaatagactgaacttttttttttcttaggatcttgaacaagataaagaggcccactcctaccacttcaattaacataactctgggtgttctgtccaaagtaaatgaacaagaaaaaaatttaaaaaggacttgaaattagaaagtaagaagtaatgttatgtctggtcactaaggtgatctttatgtagaaaaccctaaggattccacaaaaacaaacaaggaaaaagtattagatctaacaaacacattcagcaaagttacaggtaaaaaatcaatcagcaaatccagttgtgttgctatacattaacaatgaacaacctgcaaaggtaataagaaaaacattcccacttacaatagcatcacagaaaatacctaggaataaacgtgatcacggaagtgaaagacttgtacactgaaaactacaaaatattgctgaaagcaattaaagaagatattaagcagatggaaagacatcccatgctcatggttaaaagacaaaaaaccctttttaagattcatatggaatctcaagggaacctgaatagccaaaataatctttttgtttgtttgtttgtttgttttgttttgtttttattatactttaagttttagggtacatgtgcacattgtgcaggttagttacatatgtatacatgagccatgctggtgcgctgcacccactaactcgtcatctagcattaggtatatctcccaatgctatccctcccccctccccccaccccaccacagtccccagagtgtgatattccccttcctgtgtccatgtgatctcattgttcaactcccacctatgagtgagaatatgcaaaataatcttaaaaaagagaaacaacgttggagttctcacacttcttgattttaaaacttaccacaaagctatggtaatgaaatattgtggtactgccataaggatagacacaaagatgaatgcaatggaatacagcacttagaaataaaccctcacatacatgatcaaatgagtttcaataaaggtgctgagactattcagcgaggcaaggactgtcttttcaactaacggtgtggaaaatcgggatattcacatgcacatgaatgaattagacctttgccttatatcacatacaaaaattaagtcaaaatggattaaagacataaatttaggagctaaaactatacagttcttagaagaaactattggaaaatcttcatgacattagatttgtcagtgttctcagatatgacaccaaaataggcaacaaaaggaaaaatgtagagaaattggactcatcaaaattaaaaaatttctgcatcaaaggatactactagcaagagagtaaaggctgggcatggtggctcatgcctgtaatcccaacactttgggaggccaaggcgggtggatcacgaggtcaggagatcgagaccatcctgactaacacagtgaaaccccgtctctactaaaaatacaaaaaattagccaggcgtggtcgtgggcacctgtagtcccagctacttgggaggctgaggcaggagaatggcgtgtacccaggagggggagcttgcagtgagcggagatcgcaccactgcactccagcctgggggacagaacgagactctgtcacaaaaaaaaaaaaaaaaagtaaaaacacaactcacagaaatacttacaaagcatatatctgataggagtttaatatccagaatagataaacaacttctgcaattcaaaacagcaataaaactaactgaatttttttattgacaaaatacttgaatcaacgtctctccaaaaatgtataaatagcctataagcacatgaaaagaagctcagcatacctggtcactagggaattgcaaagccaaaccacaattagaaaccaattcatacccatttaggatggtcgttattggaaaaaaatggaaaataccaagtgttggtgagaagttggaacccttgtgcaactgttggagggaatgtaaatgatgcatcctctgtgaaagacagtttggtggttcctcaaaaaattagaattaccatatgatccaataattccacttctagatacagaccccaaagaaagacccaaccagatacttgtataccatcgtgcacaacagcatcaatcacaaaaaacaaaaggtggaagcaacccaagtgtgtggacagatgaacggataaacaaaatgcagcatgtacacaccgtggaatattattcagctttaaaaagagaatgaaatacctggtgcttgctacaacatgaatgaaccttgaaacattacgctaagtgaaataaggcagaggcaaagtgacagatattttatgattccacatatatgaagtgcctagaataggtaaattcacagaagcagaaagtagaacgcagattaccatgatctatgcgtctgcaccccacccaccaccagagatctctacgtgctttcacttgggtaataccaatgacaagaggaggaatgtaaagagtcttttatcctgtctctgaagccctataagagggaagtctcaacttccatgctgggagtatgggatatggggactttgactacacagtttctgtttgggattatccacaatttctggtaatagatagcagtgatgcttgtgtaacactgtgcacatgcttaaagtcacttaattacacactttaaaatggttaaagtggcaaattttatgttatgcatatttcaccacagaaaaaataaataaatacataaataaataaatgaactttggaaaaaacaaacaaaccaacctggcctgcatccagtctttcttttccatagcatctatgcagactgcccgaatcttcacgctttctttactggggggcaggggttgcagtcttgctctgtcatccaggctggagtgcagtggcatgatcttggctcactgcaacctctgcttccagggttcaagcaattctcctgcctcaccctccagagtagctgggattacaggcgcctgccatcacacccggctcatttttgtatttttagtagggatgggggtttcaccatgttggccaggctggtctcgaactcctgacctcaagtgatccctccacctcggccttccaaagtgctggcattacaggtgtgagccactgtaccctgtctgatttttcatgctttcttttgcccattttcaagctattttcctcccagagactgcaagatagagttcacttaaactctgaagacatctttaacagatgagcaaagttccccttcatgctaggtaaccctttgatcttcaaggtactcatggttaaaagagcatatacatttcagaactaaaataagatgaaaactactgattatttgtttaaccttagcactaaaaatagacctctgatgttagagacttcacaatatgatttcttcattaatctggatatatgtgtgcatgtgtctctgcgtgtgtatctcaacttattttagctttaaaaaaaattcaaaatcccctttaccatgaaaacaaggttatgctttcattttcataaagcctcttaaggtctaagcagaatattgcatatttgtaatttaaaatattgtcattaaaaagtgcatttggtgagacctagaaaatggtcacttaaaaccaaaagtaaatacaatgctttgttgataggtaggagctgcttcctctttctatctgcctcccgccatgccccttctcccaacaaccccttagcttctagctaaatagaaaggatgttctagcagctactgagtagcacctgaagtgcctgtatgaagtgcttggtctgtgtttctgttaaaaaaatgtctaacagaggtttaggtaaaatttatcctaaaggaataagaaggtaaattattttgtgaatgaggctctgagctgactcactgtatgcattgttgtaaaaatgtgtaactggaataacatgttgcttgtttgaactgtaagtgcttacaaagtattttttaaaatctaactttgaaatgttttactgtgtaagtgatgtcttgttagttggcaagttaaaaatctttttcagggtccttggctacacatcagcaggaataactgataagtccccaaaattcgagagtgttgcttagatttttcttgtaacatttcttgaaacaatgtaggtagaatcacatcactgaatccccctggcaaagaaaaaactgttgccttttacaaagaacagtatattcctgatctagaagttgcagcttttggaaaagttgccccatttgtggccgggcaccttggctcacgcccgtaatcccagcactttgggaggcggaggcgggctgatcacgaggtcaggagattgagatcatcctggctaacacagtgaaaccccgtttctactaaaaatacaaaaaattagctgggcgtggtggtgggcgcctgtagtcccagctactcgggaggctgaggcaggagaatggcatgaacctgagaggcggagcttgcagtgagccgagatcgcgccactgcaccccaccctgggctgcagagtgagactccatctcaaaacaaaaaacaaaaaacaaaaagttgccccattcgtgatgcagagttctgatggagagatatttgaagttgatttggaaattgagaaataatctgtgattatcaaaaccatgttggaagattttgagtggatgatgaatgatgaaggatatgatgacctagttcctctaccaaatattaatgcagcagtatttaaaaaggtcattcagtggtgcactcaccacaaggacgaccctcctcctccccagggtgatgagaacaaagaaaggggaacagaccatactcctgtctgggatcaggaattccttaaagttgaccaaggagcactttttaaacttattctggctgcagactacttagacatcaagtttccttgatgttacatacagcactcttgccaatatgatcaaggggaaagctcctaaggaaactgacaagtccttcaatatcaaaatgactttatggaagagaaggaagctgaggtgcactaagagaactgtggtgtgatgagaggcaaaatgtgtctgacactgtaacactataaagacagctccaaacactagttgtactgctgtgtttacagtttctaatgttagacaaatgcagcagcaaatcaattctgttagcagaatactgtcatcattgcatgagcaatctgagtagtttccaagtgtatggctaagtttcttctggtatgattgaaagtttctttttttttcctcttaataaaactaaactgtgggttctctatttaaaaaaaaaaagaaaagaaaagaaaaattaaaacactcccagtttgtagatgacatgattttctgagtagaactagttaagtgaattcagcaagtttttaggatataagatcaacacacaaaaacatactaacgacagacatgtggagatggactttaaaacacaatatgatttaaaattatctcatagaaaaggaaatatttaggtacgaaattatgtacaaattttaacaaaatacataaaagatctgtatcctaaaatttagaaaatgctgatgaaaagaatcaaaggagacctaaataaatggatatatatcatgttcatgaattggaaatttcaacatattaaagatgtcagtacttcaaaagttgacctacagatttagtacaatttttacgaaagtcccaacaaaatgttttgtagacataaacaagtttattctaaaacgtatatggaaaggcacaggaccaaaaatagtgaaaacaattttcaaaagagtaaagtgagaggaatccctgtgcctggtgttgctatatgtctacagaaaacaatgcaatgtattgctggcagaggcagagacgcctagaacccaggaacagagtagcaaatccaaaaacagacccacacaattatgcccaatgaatctgtaaaaacaattacatggaggaagggtaacctttcaataaattgtgttgggacaattattatgcatccatggataaaataatgaactttacatttaacctcacatcttaccaaaaatgaactaaaaatggatcacaaattctccccggctggactgcagtggcgccatctcgtctcactgccacctccgcctccgggttcaagcaattatcctgcctcagcctcccgagcagatgggattacaggcgcccaccaccacgcccggctcatctttgcatctttactagagacggagtttcaccttgttggccaggctggtcgcggtaattcctgacctcaggtgatccgccctcctcagccttcctaaatgctaggactacaggtgtgagccaccgcacctggcctaaaactataaatattttagaaaaataaacataggagaaagtcttcaggacttaagactacgtggtgtttataaaatagacggtgctttcataaaattatgtgttttttttaaataaaactaaacacgtatctatcatacagcccagcaataaaagttttaggcattacagtattacagagaaatggaacatttctgttcacatgaaaacatgtgtacggttgttcatagtggctttatttgtattaaccaaaagctggaaataacccaaatgttttcctatagtgaatggttaaacaaactgtggtaagttcatagaattatctttcctttgagatgccattcctgaaactataaaaacttttctggaaaacctaagcaatgaatttatcgctgtttcgtttgtatcgcctatttaaggaagtaaaatgaacgataatttttgccctcctttacctatggtcatgtgataagcccttaatagaagtcagcttttgccagcggtgcccagtggctcacgcctgtcatcccatttaggaggccgaggtgggcggatcacctgagatcgggagttagagaccagcctgaccaacgcggagaaccctgtctctactaaaaatagaaaattagctgggcgtggtggcgcatgcctgtaatcccagctactcgggaggctgaggcaagagaatcgcttcaatccgggtggtggaggttgctgtgagcggagatcgcgccattgcactccagcctgggtgacagaactggactctgtctcaaaaaaaagtcagcttttattatgaggggctctccatctccagatgcctgtaaggaaaggagtgagctaagcatctggaacaccgtgggggttttggactgagtgcctacggtgtattgggccctgtgtaggagtttcatatatattattttataacactatggctagctcttactacccaaattttacaagttaggaaactaaggattagcattacttactcaaacaaacagtgggtgagtggggaaattggaattcatatccagatgtctctgagtacagaaaccatattctctataccacacttttttgtcccttcataacttccatctgtgtgagtggccaggagtaacggattatgcaactgcctgaagcgctctggtcttgtgtccaatgcacaggatgcggaacattcgtttaaaatcttcctgcccattccacggctgagtctcatctctagccagcagaaacccatttttagtggctggtaagccactaaatttactctttgtccccaaaatgaccatcattgcatatttaagtacattttatttctagatgcctgattcatttcaagtctatgtaaattgttagtttcttatgaacaattaaatttaaagtatacatatgtcaacaacttttctgttagtgaaactgtgagatcctgtcactcagtgtgacatcgctgaaaattaagggattcgcaatctttgctgacttgtgttccaagtctggatcaactatttgctgtatgacgttggcaatattatttaacctctaatagagttcatctgtttatctattaaaacagtgaaatgatatttatctgaaagaatccagtatattaatttagaggtacacccattaacaaacacattactttatgtaaattggtaatctatatctgcttctgcttattcattactttaaataactacaaagaaaatattcagacccagggacataaaataagcactcaaataacgtctgttgaaaaaaatgaatgtcacttttgtcaaattatttctaaaaaaaaaaaaagtaacttatttagaaaatctcaaatctacattaaggaccttgtattttagcattgtcaccacttttactgagaggtcagtagggactattcctgattctggaaggcagaacatagataaggagacccacaaaattggagtctgatctgggtcacattttcaacatttaaaattaccgtgtgactttggtgagtcatttgaattctccattcctgttctctatctataaatagaaataataaagacatttattcttaaattaagtttcaatttttcatctataaaatcaagtgctaaatatacacatttagcaattataatgctatacagagatgtttctgtaatttctattcttcttccaactttgcaccattttgcaaacatcctcatgttaaaggttgcagtttcttccagtttcttactaccatgatgtgctcataaatgcttgaaatcccatttgaacaggattcaggacagcgtaaggtgttaatctgaccatttgtttttaagagtctatcctgtttaaagccatgagatacatttctaagtgttctgaactacatcatttaaatcttctcatatcctgtttttaaaaaagtggtaatcttgggtgaagccacttgatcaataattttttaaggtccttaattttctcaactccaggacattttcctatccattggaccacttgaatttcatctttatgttttgtaggtgtttttggtaatttcctttttactgcattccatgacttttaatgtttccatttagggaattgttctcaaagaatttgagttgaaactcatactacatatttataaaatgtataaattatttacagcttagcattaaaaaaatcaaatatgtccaattcaagtagctggtacagaatcacttattttcttaaatatgatacgttacaattatatcatgttttaaatctctaacaaacctgactccataatatttggctacaagtgtatataatacaaatgcttatatgatggctgagaaaacaaaaattttcattcttacactttttaaattgttattttgtcttcttttaatggatacttggtacagtttcacctggatgctctctatattcaggggaattgcagagttacagggatactgtactatgtggaattgccccatcaattaaatgcaggatcatgacaatgagcaagtaaggaggatttgatgccactcctttacaagaacgccttgctagggtttggctgtgtccccattcaaatctcatcttgaattgtagctcccataattcccacatattgtgggagggactcagtgggagataattgaatcatgggggtggtttcccccatactgttcttgtggtagtgaataagtctcacaagatctgatagttttataaggggaaacccctttcacttggttctctttctctccgcctgggaaaagcatcccttgctcttccaccataattctgaggcctcctcagccacgtagaactgtgggtcaattaaacctctttcctttataaattacccagtctcgggtatgtctttatgagcagtctgaaaacagactaatatactcctccatgggaagaaaaggtttgagggtctttggagaacagagtatgagaggaggatgcccagtaagggggtaccagtgcctgcatctggaggcaaatctcacaggcatttatcacagtcagacattaaattatgttgtattattttaaatgtaagcagttgacaattacgccaaactagaagctactgcttcttttagaagtaggtaataaaataattaactctgaagtaatgtactgttcagaagcagagcagatatacataaacctaaacactaagagctgggtctccaatactaaaagaacgctactttggcactccctgatagagggagcgctattaataatgtggaaacgtttttgctaaaagagaaggattaacattcatgccagcatccaaattgttcttcttaagatattgtatatttatattataaaatatgtcctgtttctgattttattaatttatttcattcattaaagatatatcagcaagtggcagattaggaagctccagggccatattttcccataaaaatgtcaaataaaaaatatatagaccaaagtcactttgtaagaactcctaaaattagctaagaaacaaagcaaatgcctaactgaacaaaaggccacattggaagcagtatgaaatttcatggcatttttcttgcccttaacccacctcctcttcaacatagtgtgatgtgatcaggaggaatttgtccaatccaagttccagcctcaagctggaagaggaagagaggagcttatctggagattgactggaagactatttctatcttacctgatttaaaaagctgatggaagtggtggcatagtttgaatagccattcaaatgaccttgaataggttcaaggtcatttaaaacagacaggcaccatggtgactaagagccacaagcggtcagaagacccccggtggcacagattatagacaaaggaaaacaataaaaattccctgacctctaagaagcagcagcaatatgcctcttggggaaattaagacatttaaagcagccttgtatatggggaactggaacaaaagcatacacacaaggcaaggaaagacacatctccagtaaaagtatgaaaggagcttgtacctttatgccaggatgattagtaaaggtcttcccctgcatagagccagtccacaaaaagctaggagacaaggctacttttttcaaatgctcaattttcaacaaaagatcacaagacacacaaaggaacaggaaaacgtagccccttcaaaggaacaaaataaatctccagtaactgatcttaaagaacagcagagcttgggcttatttgataaagatattcaaacaataaagatgtctaaagtatgctaaatgagctgaaggagaacatgaacagacatacaagcaaactcaggaagatattttatgaatgacatgagaatattaacaaagagataattttaaaatcacagaaaacaaacaaacattctgaacctgagaaacagagtaacttagttgaaaaatttactatagggagacttgatcaggcagaagaaagaatcagtaaacttaaagatatttgtcattgttgaatctgaggagcaaaaagaaaaaagaatgagtaaaagtgaacagagtttaagggacatatgggacattgtcgagtgaaccatatacattatggaattaccataagaagaagagacaaagagacagggagcttatctgaagaaacaatggatgaaaagttcccaagtatgaggaaagaaatgaatacacaggctgggcgcagtggttcatgcctgtaatcccagcactttgggaggccaaggcaggtggatcacctgaggtcaggagttcgagatcagcctggccaacatggtgaaaccctgcctctactaaaaatacaaaaaaaggttagccgtgtgtggtggtgtgtgcctgtagtcccagctactcgagaggctgaagcacaagaatcatttgaacctagcagtcaggagttgcagtgagtcgagatcacaccattgcactccagcctaggtgacagggtgagactatctcaaaaaaaaaaatgaatatacaaatacaagaagctcagtgaattttaaatcggatggatccacaaagatccacactaagacatattataatcaaattgtcaaaagtcaaagagaatcttgaaagtagcaagagataggtgacttagtatgtacaagaaaatctataatattaacagtgaatttcttatcggaaaatttgcaggccaaaaggcagtgggatgacatatttaactgattttttttaaactcctgtcaactgagaatactatattcagtaaatttgtttttcaaaaaaatgaagagaagtaagacatttctacaaaaaaactgaggagtttgttactgttgggaaaggcagtcttgtgcatgcaatcttttgaccctcacttggccatgtgacaatgggcctaaggtctggacaacttctttatcacgagaataaagaaccttcatatcctgtactgggattatcacttgtgtgggaatattttagcctgtttcagactcaatgtgtattccttcgttcagcttaaaattgcacatattatggcacctagccaaacctgatactacatttgccccctgcagggaggggaagggttcttctgtagcacaagagaggtatgtaccgccaaattgtcctgtgtcagctgctgggcaggacctactggccatgggagacccatgaccactagtggagctggtcgtgctctgcctctactctgtgtaagtaaagcattaatctattcagcaattggctgtactgtgttttccttggcaactccaataccaagatgcagtaggcagaagtatcagggttttcactcctggtgatagacaactgatttcacttgcttgatagtaaccactacaccattcctattagaaatgttaaagaaagtccttcaacttgcaacaaaggacactaggcagtaacttcaagccctataaaaatttaaagttctttggtaaagataaatgtatggacaaatatttaaaaattgtgttattataattttcatttgtaatgccacttttaattatttaataggatttaaagtttaaaaagcataagtataaatctatattaatgggtacacaatatagaaagatactttgtgacataacataaagtgggagtgtgaagacagttataaaggagtagagtttttgtatgtgattgaagttgctatcagtttaaaattgatttttctaacttaactgttttatgtaatccccatggtaacacaaaagatatatctagagaatgtacacaaagagaaataagaagaaaatcaaataaatgtcactgaaaactcaactgaacataaaggaaggcagtaagtgaggaaataaggggaaaaaacctataagacatagagaaaaattagcaaaatggcaatagtaaatctctaatcataatatatattttggcagaatggataaaaacacaagatgcaactatatactgtctacacaagacttgttataaatccgaggacacgcactggggaagggaaagaatggaaaaaagataattcacgcaaatattaaaagaagagcagcaagtggctatatcgatattggataaaagagatgttaagttgaaagctgtcacaagagagaaagagggacactatataatgacaaaagggtcaattcaccaagaagatataacatttataaatatatatatatttatatatatatacacagtaagcatcagagctcctaaatttatgaaacaaatgttgacataattgaaaggaggaaaatactgatgtacaagaattatagggactttaatgtcacatttcaataattgattaaacatccagagaaacgatcagtaaagaaacagaggacttgaaaaacattatagaccaattgaaactgacagacatatacaaaacacttcacccaacaacaatagaatacacatttttttctcaagtatacatggagcataattcagggtagaccataggctaagcccccaaaaaagtcttaatacagttaaaagattaaaatcatcacggtacctttttttattatgatggaatgaaactagaaatcaatagcaggaggaaaactagaaagtctacaaatatgtggaaattaaacaacaaacccttaagtaaccaatgggtcaaagaaaaaaatacaaggaaaattagaaaatatactgagagaaataaaaatgtaaacacagtttattgaaacttgtgagatgctgaaaaagtaatagtaagaaggaattttatagctgtagatgtttatactataaaagaactaaatcaacaacctacctttattccttaaggaaatagaaaaagaagaaacttcacacatctggcacacaaaaagatacaataaagattacagcagagataaacgaaattgagactagaaaaacaatagagaaattagtgaaacatagggttgactatgtaaaacatgaacagaattgtcaagcctttagctagaacaactgtgaaaaaggaggaagctcaggggccgaagcgcagtggctcacgcctgtaatcccagcacttagggaggccaaggctggcggatcacgaggtcaggagatcgagaccatcctggctaacacggtgaaacccggtctctactaaaaacacaaaaatttagccgggtgtggtgtggggcgcctgtagtcccagctactcgggaggctgaggtaggagaatggcgtgaacccgggaggcggagcttgcagtgagccgagatcgcgccaccgcactccagccttgctgacagagcgagactctgtctcaaaaaaaaaaaaaaaaaaaaaagcccccagtttacatcacactcagtgttgaaagactgaaagggttttctctaagatcaagaacaaggcaaggatgtccacgtttgccagtctattcaacatagcacttaaagtcctaaccagaaaaattaggcaagaagaggaaatttaaaaagatatccaaaatggaaaggggaaaattaaatcatccctcttctcagattatatgatcatacatgtagagaaccctaaaaatatcacaaaaacctattagaagtacagtttacccagaattctactactccttaccaaggagcatctattcttatactgatgtatgacatactttcaaactttctcaatatcaaagagattgtctcaccagcagctaaggctgtattgtactgatctgtaatatttgttatttcaagctggaagatattatctgagagtttgacatatatttgatcttaaagaatctcacagaaaaaggcttctcttatactgtcaaattttgaagtaggaaaaagactttcgagattgctaaaaaaataacctgtaacatacctaaaatgctttgtatcctgataatcccagaattcaggtaaaatgttgatttgatgttcacaaagggagtaatattttagttacttaaatactaacatgggtataatttaaattactctggttaaggatagtacaagactctgtgactgtaaacacttcacctgagccaagtttgaattatttaatgtgttatgtcatttatttattttccacaaagaaatgtccttccccctcaggctgaaaaaaaaaaaagtctagaatatgaaggagaaccatgggaagagaaaggaggcaaagaactacaaagacagatctcacaaaatggaaatgaaatgtattggaattaagaaggaacaccttccttttagtaatatcatagtacagccaacgtaaaacaagaacatattattgtacccaaagtcaatggactgtgtaatgtccaggacaatccatgactcatcacatcccacagccatgttaacagatgccaacaggctcagcggtgcccccagagctacgcctgctagacgacacagcttaaataaagtgaaatacaataatctatgacaaagtggaaaaaaacaaggaagtggaaaaaataagaatgttctttgctgatccacatgttccatgagaaatcttatcaaggatcttataaaagtgataaaatcatagatgagaaagacagttgcagaggtcaaattgcaatttcacattttgtttaatttgttgaaagtatttggtaaacaatctgtgtactcaagaataattcaaaatgttgccaccatgttttacaaattatttttaaggataagccatcttttcttctaatgaaattaaacaacagttattaatagtttggcatttctataatggttttatctttgttgattgtaaagtgagtcctcacaacataaaccaaaatgccagcatttcacgagtgcaacatagcagaacttttttttttttttcgacatggagtttcactctggtttcctaggctggagtgcaatggcgtgatctcagctcactgcaacctccgcctcccgggttcaagcgattctcctgtctcagcctccctagtagctgggattacaggcatgcaccaccatgcctggctaattttgtatttttagtagagatggggtttctccattttggtcaggctggtctctaactcctggcctcaggtgatccaccctccttggcctcccaaagtgctgggattacaggcataagccaccgcgcccggccaaaacacagcagaacttctattgctttacggggaagggacttccataattaacatggactgaaaaaatgaatttaaaataagtgtgaaagggggcatctgacatgtgcaatgatcattaatctcattgcgggacctttaaaatccacctacatgtgtgagggaagtgtttgtctctatatttttgttcctctaagtaggtctgaatcccattagggtgaggcacctggggaagcacctaggaatagtgattcctgacatgtttctcacaatttaatacttcataatttagaaagttttcccatacattctctaatttgagtttcacagagatcctgtggaagaactctgggcagatagaagtccagaagagaaacaacagctcaggaatgtcacatcattggtccaggagctgtttccttatttcctctgaacctaattttactgagaatattttttttccttagaaaaaattctaaagacctcatttttttttttttttttttttttagatggagtttcactcttgttgcccaggctggagtgcaatggtgcaatctcagctcactgcaaccttacctcccgggttcaagcaattctcctgcctcagtctcccgagtagctaggattacaggcatgtgccaccacacccagctaattgtgtatttttagtagagatggggtttctgcatgttggtcaggctggtcttgaactcttggcctcaggtgatccatctgcctcagcctcccaaagtgctgggattacaggcgtaagccactgtgcccagtctgcaacatatttttaatttctgaaaattatactttgaaaataaatattctagtaataaaaataggtaactcaagggacacagagattcgcttttggtcagagaaaccatacttccctttactggaagactgatttttttttttttaactactgaactatgacaggaatgttttgaactggagcactaactatgggctacttgtgtatctaggcccttcctcaataaatttacaatctataaaagaagaagaaaaccagataatacaacttgtaagtagtactgtgagagatttttagagaaaaacgtgctggcatataaaagggtcatgaggctctattgactcaaacttgttcaagaagtaaacaaaagcctaaaagcctaatgataacaaaaatgtgcatttataagtatgcagttttaaaaagaacgctacattgattttctgccaccactctctaagactcccttctgtaggttgctatgctgggctttatgacagctctaacacctgctcctccccagttctcctttgcctaatttctgatgtaggtgttcataaaaatcctaccccaatcttctttgcttctcatttccatcctctacttggcaattctatccattttaccaggtttaagtaactatcactgctatgtgttcatgctcaatttatcttcttagctccagaatagaagctactgtggattatttatatgtgggtatctttgtgtgtgtgtgtgtgtgtgtgtgtgtgtgtgtgtgtgtgtgtgtgtgtgtgatggagtctcactctgtcacccaggctggagtgcaatgacgtgatcttggctcagtgcaacctccacctcatgattttaagcgattctcctgcctcagcctcttgagtagctgggattacaggtgcctgccaccgtgcctggctaattttcatatttttagtagagatgggggggtctcaccatgttggccaagctggtctcgaactcctgacctcaaatgatccatccaccttggcctcccaaagtgcttggattacaagcatcagccacctcactcgcctatatgtgggtatcttacagattacctcaagctcaacaagcacaaaactcttctaggcagcaaatctctaaaacctgctcctctcctactcataattgccccattatcactcaggcttgaagccctggaattgtctttatttttcaaacatcctcttctttgattctctttctatatgcatttagatctcctctttcaagttgccaaaggtacctttatattatatcatgtaaatatttttgatattttactcttctaaatgattaagttgtttggtaaagaacaaacatccatactcttcaatcttctatccttagctttcatgattggagccaattctatgatttcttattcatccaatctgtacttccaacgcttccccggcacatcctgctgaaatctctatgtcagcctatcatataggataacagtcctgtgttcttattataaaatacagaatgtgggggatttaaagaagaccatcttttacctcctgtgaaagttaaagggagcacagtctacaaggccactctcacttctaacaccagttgcaagttcaagggattcccaaaactactttcaggtttggtaattcactagaagggctcacagaactcactgaaaggtgttagactcatggttatgatttattacagtgaaagaatacagattaatatcagtcaagaaaagggaagcatagagaaaagcccaagacagtaccaaatgtgaagcttcctattgttctctccctgtggaatcaggacagcatttcctggcatcaatgtgtgacattgcttaggtagtactgccaagcagggatgctcacctgagccttgatgtccagagtcttatccattactagatagttgactgtgcatgtggctgtcttaagttttcagacctataggacatgtagcctgtgactcaaagctccaaccccactttaaatcacattgttaatatcttgctggctcaaggtccccaggaaagcaaagatgttcctatcaggcatgatgttccaagagctagagattacctccaagaagccaagggtaaaacccagacctttctttaggcaagactagcctgggcaacataggccccatttctacaaaaaaaaaaacgttatctcatggtggcacatgcctattgtcccagctattcaggaggttgaggcgagagggtcccttgagtccaggagattgaggctgcagagagctctgatcatgctgctacactccagcctgggtgacagagtgagaacttgtcaaaaaaaaaaaaaaatctttactatggaccctcctactttcttaggttttcaagatgtgtatgtagataaaatggatttgtaactgggctgaaaaacctgtctttgaatctggaaacacctggatgtctggtttttttacccttggctaagctagggtcagtaagatttatgtaattctgtttatgttctgacccggagactttaatacttactttctttactaatggtttgccactgacataaccaggtgaaaagcgtggcttgcttatatgactacagggacttataacacccctataagggcttctctgaactcccacaaagccaaaattcctggtccagatcttagaggttcaaattagagacacagcctggtcccgtgtatgaaaagaaggtggccctggagagttgggatgtcaaaatgtctcttgtactcccaatgtttgcttgctttttccttctcttgctgtatcacataatttgcatttttgtcaaaaaaaaaaagtacactttgtgtaatctgatgaatcctttcaaatatatgaactgtgggaaaaaaatataccagagtttattacacttgcagaaattttactaaggattagaaaaatttcaaatatcataacctgaaccaagaatttcatatgtaattaacaccactatctccttcatagttcagaaaagtgataagatgaaattcaataaataagtctggggtttcagtaaatataatgtcaaccactttcttactattgaataacagtttaaattttagttacttttatgattttaaggtacttcattaatttaactactaaaaatatttgttagattgcacactaagtttcagactctcaaaaatgatgaaaattaataaaaactatattataaagaagtagttgaccacagcagagacagaggtatagaaagaaaactgagcaagtctggtcagaggtaggcctggcacaaggacctggagaaggcagtgtcaccgagagccggtggaggaaatgaggctccataaacagaactttggttgtgatctctggttttctagccaaactgtcttgtaatttttctctcagattcctcaaagaaatgggcagcaattgtaaagtgacagtaatgattcagctaattaccagacaaaaacaaatgatgacttaaaagcaccatctctcaacaagtataatttaggccttctatggtcatggattaaaatacttaatattgttgacatgtcaatactcctcaaagtaatctatagatttaagcaatcccgataaaaatcctaatgtctttttttttacagaaatagaaaagtccattctaaaattcatgtgaaatttcaaggacccaaaatagctaagacaatcttgaagaaaaagttaaaggactcacactttcctgactttataatatgttataaaactacagtaatcaaaaccaatatatttctggcataaagacaggtatatagaccaatgtgataaaacagagggcctggaaagaaacaatcaaatatttggtgatgtcagataaggataacaaaatcactcgatggggaaagggcagtctctttaaaaacggtgttggaaaaactgaatatctgcatgcaaatgagtaaaggtaggggcttatcttacaccatatacaaaagttaactcagatggattaaaagcctaactgtaggatgcaaatctatacaactcccagaaggaaacatggaagaaaacttcacaatattagattcggcaatgatttcttggatatgcctccaaaatcacaagcaacaaaagcgaaaatagacaaatgagattacatcaaacttaaaaggttttctgtaccaatggcacaatcaacagaatataaaagtaacttatgacatgggagagaagatttgcattatatatatatatatatatatatatatatatatgggttaatattcagacaatctaaagaactacaattaaacaagaaaaaaaatcaaataacctcattaaaaaatggagaaaggggcttcaggagacatttctcctaagatgatatacaaatggccaacaagcatataaaaagatgctcaatatcactaatcattagaggaatgcaaataaaaccaatgtaaataaaatgataactgctatggaaaacagtatgccagttcctcaaaaaattcaagacagaactaccatatgatctaacaatcccacttcttatggttaattttatatgtcagctacactgtgctatggagtactcagatatctggttaaatatttctagatgtgtccatgaggatgtttctggatgaaattaacatttgaattgataaactgagtaaatcagattgccatttgcaacgtgtgtgggcctcatgcattctatgaaggccagaatagaataagaagctgaccaaaaaagaatttcttctttcttcctgtctttgagctgacacgttggtcttctcctgcctttagattgaaatttatgccactgggtctcctgggtctgaagccttgaaacttagaccataaccataccatcatctctcctgggtctccagattgtcgactttagatcttcagcttctcagcctccatagcacataagccaattccttatattaactggataacctagattagtacagtatataaccaaaggtactgaacacaggatctcaaagagatatttgcacactgatttcatagcagtactattttcaataaccaagagtcggaggcaacccaaatatccatcaatgaaagaatgagataagcaaaatgaggtctattcataataaaatattattccactctaaaaaaatgaagtactgatatatgctataacatggatgaactttaaaaacattaggctaagtgaaagaagcgagacacaaaaggtcacatattgtttgatctgatttatacgaaacacccagaaaaggtaagtctatggaaatggagaacagactagtggttgccaggagctgggcaagggagaaatagggagtaactgcttaaaggacatgtggtttcctttagggttgatgaaaataacttggcactagctggaagtgatagctgcacagcaatgttaacgtgctaaatgccactgaattatacacttaaaatggtgaatggttaattttatgttacacgaattttacatcattataaaaatttgacccaaaaagtatgatttgaatactcttgatttacaataatttattattaaatccttacatatgggtcttccaggttaaggttgagttccagataataaatttagtaaaatggccctacaactgtaaatatgctgcatttcaaattgcatgcatatgcaattttgcaaaatagataggcttttaaatgtttgataagcacattccaaaaaggcaaagtcagtaaaaaagtaaagctctcaaaattaggatttgactactttgttttcaaaaatattgcattaatatttaacctaaaattgtaatttctaaatatcattcgataaaaaaccagattactaaaatctgaaatataatccaaagaagaaagtgctaataaaattaaactattttttctgtgttttttgagacaaaattaaactattttttcttcccaattatctcctatagaaaactcttttctccaagattatttacacaaaagactgagaaaacaagattatacacacacacacacacacacacgggtgcatgcacacagtttacagtaaactacactgactctccacttggtcaaaacaatagtctgttcttggaattattctgtctctaatcttaatcattcattgaactttctcagttacatgtcctataaggttataaccatcatattctactctaagggtgccaagttagtaaacaggggtggcaatgagattcacagtatggtccaaagagatttgatacggtctaattggacataggtatttgttttgccctctttttctctcttgccagaaaatgttcaaattaactctcatggcctgccaaaacactactttattaatgacttggtagagcaatatactttcctcattgaaagtttgtagagcggtatactccttgctgtcagtgaaacattcaaatagaaagtccaatgaattaaataatagatgtgatagttttattaacatttaactttgtcaaaaggatcattgagaagacagtcttttttcttgcaaacagaaaagcggtagaaagactaaacacgactttttattatttctccttatatttctccagcattggaatcctgatctacttagtaatgctttctcaaaacactagctaccgtttatgttggtagaaccagaaaaatgccctaatgtgtccatagaaaagaattaattttggccaggcgccgtggctcacgcctgtaatcccagtgctttgggaggctgaggctggcggatcacgacgaggtcaggagatggagaccatcctggctaacacggtgaaaccctgtctctactaaaaatacaaaaaattagccgggtgtggtggcagcgcctgtagtcccagctactccggaggctgaggcaggagaatggcgtgaaccctggaggcggagcttgcagtgagccgagatcgcgccactacactccagcctgggcgacagagagacactccgtctcaaaaaacaaacaaacaacaacaacaacaataaaaaaagaattgagcactttatgaaatactttttatattatactatttcttcctttgagaaataccattattagtgcacaaccgatcaccatagcttaaaatcagattacaaaatacaaggaaaatacttacaataggaaagttcacccctaagcatttctttatgacacttttagccatatgaactcaccactatttattagaatgcaatatctcaaaatagaatatggtataaaactgattttttcaaataaatacataataaaaattattaaaatatataatttataaaatctaaatgtttactgatacatgttgtatttaatgttaatatatccaaaaagtttaggctcaaacttcataatagtgacccttttttctcagcttccccccccaaaaaaattattaacctttgtgtatttctctactttgttcacagatacaaaggccagccagatggagctggtcaatgttcccagatcttaagtgcagtgactcaaatctaataaaaaggcatttggaatacagcattgataaagttgtatgactgtacagggaaacattctgcttgtagccatgagatatgaacttctgtttactacttcttctaatagttactagaaatatgagagccaatagaccctttatttttatttcaccctttcctctgagttgtattaaatgacatttcgaatgtcaaatgaatctgatatctacagtcaaacataacagcatcaatggtaaatgtggccaaggagtcagatatgtcaattctgcgtgaattaatctgtttgtgcaaatgatacttatcattacctatgatcagcacttttagctttatcatatcataatttacccaatatgtataggtgtcaacatgtgtgaagataggcaccagataagcaagactcattaagatgttgccatagattaatcctacagagtagaagcatttggctgctctgatttttaagatccctgctttagagcctagaaaatatcatgaaaatgaattaatcatttttcttttcagtatcgtcaacaacctctagtattggagatgttataggaaatgactacctgcttgtaattccatttttagtcaaaactaatacagaagtatttgctagatttggaaatacccaaatgtaagtcagtggcctaatctctaacgggtttaatagcctattttagatgagatcttttccagtaagtgttgtcttccagattttcatgtcctctcgctaatgttttccaaggtggaatttgggcatatgagggctcatgtaaattcatggcattgggtgggtggagagagtttcttgggacatatgagtatctgtgttggtctccactggtcaggtccttcagtccttagatccttagatgacatcactaaggtatagttaatctatacttaatcacaggtgttttttttaacaccacttccaaagtctgtggttgctacgtcccactggccattcagttggcataggccatattcccagaaacaagtacatcgccctttgctgatgggtgccacatcatttctgctgatgctataggcactccaaactctgattgtaaggcctacctgattgctggcattgagtagcattgctgcccttgactacagactcaattaacttcctgatcatttcctctgttaatttgtacccagattctcagctaatatatgtgttgtcttgaaagacatgtgaaaaactctgtgccagagggaaaagaagagctctggatggtctcactctggtaatcaaatgcttccacttccactcacaagtcattgggcagaattagttacatagttccaccctacctcaagtggacaggaattacaatcatgctgtgtacctgaaagggaaaagaactggaaacatttgttgaacaggctgccacaagtaccctgccaagtgatctcccttcaaaaactcaagtaggaagctaaattaaagtcatcatctcttcttcacttgttcctcagtgtaactaagaagacttgacttctgggactttagctctgatagaggagtttagatatgtgtctcacctcctgaactttctgccttcatccccttttcattctcataatctgtcatgaccagaaaaaggggacgccttttctgggctgatgtggaactacatggcctcttattctcctctttttggattggtattgcaataaggtaaaatgatggctagggaacatgatttactaagaagaagaatattaaacatatttactattttcaaatatgatcctgttacatctgagtttatactccatacagcattttatgtacaatatttcctacaatattgtcacaaacattacaaacctaacaataagcttttattcactttgtttaacttattatttgctgatgatgctttactcactccctctgggaaggtctgccttctttcccaatcgtatgtggacatctttacaaggcaattcgagttcttaaatgtttgtatatcaaattctgtttcttttgaaaataattttatgtcttaggtgatatgtgaatagatttataaagttattaattcaatagcccataatgaacctttgggacatacaccatgacatatttgttcaacaattttaaattatttcttaatattatagattatcgtgatgaagcatattaatcctacagtcttttcatctccctgtagtcttcaattcagcattaatggagagattttcaagcaccacaggacttgatgcagctaacttgaagataagcttttggggagtttcctgttatctttgcacagtggcctttgtgagtaggccctttccatgttgttagattctctctaagaaacacatgtattagaaacactataactgtctctactatgaagatctaatgccactcctttgctcataatgtatgtgctcaactaaaaatgtttctttgacaatgcactaagattcttctaaagcctatagaacatattatcattgcatctatgtaagaataccattcaaaggagcaatgaaacaaaaagttgattctttgaaaagagaaacaaaattgataaactgctagcaaccaagaaaagagaagagacaaaatcagaaatgaaaagaagacttacaagtgataccacagaaaaccaaaatttcatctgtgactattatgaacaactacatgctcacaaaccaaaaaaatcccgaggaaatggctaaattcctggaaacatacaacctcctaagattgaagaaggaagaaactgaaaacctgaatagaccaataatgagtagcaggattgaatcagtaataaatacatttcccatgaaaaaaaaaagtccaggacctgatggattcatagctgaattccataaaatgaacaaagaagaactaataccaatcttcctgaaactgttccaaataatctgggaggagggacttcttcattcctcatgtaacaaggccagtatcactctgatactaaaaccagacaaagacaaaacaaaacaaaaaaagaaaactacatgccaatatctctgataaacatagacgcaaatatcctcaacaaaatactagcaaatggaattcaagagcacatcaaaaaggtaatacaccatgatcaagtgggttgtacataaggaatggaaggatagttcaacatatgcaaattaataaatgtgatacatcacgaaaatagaatgaaggattaaaaacctcaatagatgcagaaaaatcacttgacatccttttcaataaacggtgctgggaaattagatagccatatgcaggaaaataaaacagaacctgagaggtgaagccagctggacttcctgggtcgagtgaggatttggagaacttttctgtcttaaaagaggatcgtaaatcagcgctctgtagctagcaagaggattgtaaaatgcaccaatcaacgctctgtaaaatgcaccaatcagtgctctgtaaaacgcaccaatcagcagtagctaaaagtagccaatcacagggaggattgaaaaaagggcactctgataggacaaaaaccaaacatgggcagggacaaataagggaataaaagctggccacctcagctggcagtggcaatctgcttgggttaccttctatgcgtggaagctgtgttctttcgcttttcacagtgaatcttgctgctgctcactctttgggtccgtgccacctttaaaagctgtaacactcaccgtgaaagtctgtgacttcattcttgaagtcagtgagaccaccaacccactggcaggaaccaaatctggacacagacccttatctctcaccatatgcaaaaatcaacttaagatgtattaaagacttaaatgtaagacccaaagctatcaaaatactaaaaaccttgagaaaattcttctggacattggtctaggcaaagaatttatgacttaagacctaaaaggacagggaataaaaccaaaattagacaaatgggacaattaaactaaaaagcttctgcacagcaaaagaaataaccaggtgtgtaaacaggcaataagagaataggagaaaatatttgaaaactatttatcccataggggactaatatccagaatatagaagaagctcaaacgactccctcaacaaacaacaacaacaaaaagcgcaaacaaggccaggcatggtggctcacgtttataatcccagcactttcagaggccaggacgactggaccacttaaggagtttgagacccgcctggccaacatagcgatagcccgtctctactaaaactacaaaaattagccgggcatggtggtgggaacatgtaatcccagctattcgggaggctgagaggcaagaatcccttgaatctgggaggtgaaggttgcagtgagccaaagttgcaccattgcactccacattgcactccagccttcgcgacagagggcaactctgtctaaaaaaaaaattaaaaaaaaaaagacaaagaacaaataatgttctttaaaagtggtcaaaggatataaatagacatttttcaaaagaagacacacaaatggccagcatgggcatataaaaaaaatgctcaacactaatcatcagagaaatgtaaattaaaaccataataagatatcatcttcattaaaatggctattattaaaaagataaaatgtctcatctgctatgttggtgaggatatggagaaaaaggaatgtttatatgctgttgatgggaatgtaaattagtacaacctttattgaaaatagagatttcccaaagaactaaaactagaacgactgttcgatcccacaacctcactactgggtatctactcaaaggaaaataaatcaatatatcaaagaggtacctgcactcatgtttcttgcagcactattcacaatagaaaagatatagaatcaacctaagggaccaccagtggatgactggataaagaacatgtggtatatatacctgatagaattctattcagccacaaaaagaatgaaatcacgtattttgcagcaacatggttggaactggaggtcattatcttaagcgaaataagccagatatagaaaaatatcgctcataagtgagtgctaaaaaaagtgtctgcctggatgtagacagtggaatgataggcagtggggactcagaattgtggggggatgatgagaaattactaatgggtacaatctacagcatttgggtgatggataccctaaaagctctgccttgaccactatgtatgtaacaaaattgcacttgttacccataaattcatacaaattaaaaaatatataagacaaatgtaaccatgctttcttcaaaaaaacaaaaacgaggtaatccccattgtagtcccaaagatgggaggagagaggctcatccaagaaggccagagagggctggatgtaccctgcttccaaatctgctgtctctcccacaccccttacaacagaccctttgctctcccttctacctccccgttctcagaggcttccctttctctatttctcatctgtcccctaaaaaggaaggcagaagattccaattccttgtacccttaggtacttggagcagaatgaagtaaatttagtgaatcatttgcaactctgtacttcttgggtgcacttcaaatatcaacaagaacatttattctgtggaatagactggtttaatttcggccttttacctcaactttcagccgtctgaaattgtgtagacttttccaaactgtgttcatgtgccaccctgacctactgcctatccctgcaattggatgggccttaagaacccagctccaggccaggcgtggtggctcatgcctgtaatcccagcactttgggaggcagagacaggtggatcacctgtggtcaggagttccagaccagcctggccaacacagtgaaaccccctctctactaaaaatgcaaaaacgagctgggtgtgctggcaggcaggcacctgtaatcccagctagtcaggaggctgaggcaggagaatcgcttcaacccaggaggcagaggttgcagtgagcggagatcataccactgcactccagcctggacaacagagcaagactccatctcagaaaaaaagaacccagctccagacactgctccctgatgaacccagctccagacactgctccctgatgtctatgcatccaagaggtgccttcttcccagcagctatcactctagtggaacaaagcaccaggtttcttctctaattacttctatcagtaaataatttccaggcacctaagagtttagatttagccatgtctttgaggactgtaatttttccctaatttgtgctttctgtaataataattagggatttattgcttatattaaaaactcatcagaactctaattgaaaaggttaactacttctcatgagttcaagttgggaattactattcaaattcactgacaacttaaaatgtaagataattttctttcctaccgtgcaggtccttcatgtgataaggattttacttttgccaaacagaagttcctagaacatcctgggaatatggcattttagaagaaaaacaataagcaattacttaaagcgaatttaacattcagaacaaaacagtgtttcatttgattgatacatattttgtttttaccttgaagaacgtaccacaaaagaagggtcacagcaatgagatataacttcacttaacttttcaaactgatactgtccaaatatttaataatattctgttgattaacacagtgcttttaaaactatggataggaaaagcatatttcttgtagttatatgtcttggaataatatataaatcacacatcagccttaaatattactgcttagcagaagacaatcataaaaagaattttatcaatttaaattagaatactaaataatccagtaaagctagcatttgcagaacacttggtgtgttacacataaatattcaattaattcacagaaaaatcacaagagattgtcagttgcataatgtcactttgctagttaaggtggtacagagatttaaacccaagcccagatgcacaaccacatcagcatagagacagatgttattgcatgttggcagatgaaattgtgaaagtgaaattcccatggttccaaatcagaaattgctgccttagggcgtggggaggaggtgacagtcatttagacggctggtgggaaaattttaaaaataacacaagagggataattggcaatgtcatacaaataaataaatgacaacttttctgagtggaagaaggcaatccacaaggaggctggtgggttactataagtccactttcatattcattattttcttttcttcttcttcttcttctttttttttttttttttttgagatggagtcttgcttgtcacccaggctggagtacagtggtgcgatcttggctccctgcaacctccacttccccggttcaagcgattctcttgcttcagcctcctgagtagctgggactacaggcgcctgccaccacgcccggctatttttgtatttttttttttagtttcaccatattggccaggctggtctcgaactcctgaccttgtgatccgcctgctttggcctcccaaagtgctgggattacaggcatgagccaccaagaccggccatattcattcttttctaaatggtgattcttatgagaaatactcatatcccccactaaatggagatgttaattgtatcaatttttataacagtgaaatagtacaggtccagttctccagcaataggtggctgactaagcaaataatagtgcctccatgccccagaataacaagcagccatgaaaaaataaggtcatatttactgataacgttaatatatattgccttttaaaaaggcaagatacagaatagtgtgcatattgtgctctgtgaataaaaagttactacaataggtttgttttactcagctctttttaatctctgggaaagcttggagccacagaactaacgtcaggaatgttcgtttggtcagtgattaagattgtattctctatggcccaggcagtgggtcaggatgtaccaggctgacagcattgtttaaacatgaaaattcatgaagtgtacctggtgcctgtttggcatctgcaacttggctggttgggtagctgtgtgatcagcagcctttaagaactctggattctgagatttgagtggactttttttgttgtttgtttgagacagagtttcgctctggtcgcccaggctggagagcaatggcgtgatctcggctcactgcaagctcagcctcctgaattcaagcaattctcctgcctcagcctccctagtagctgggattacaggtgcctgtcatcacgcccggctaattttttgtatgtttagaagagacgggatttcgccatgttgggcaggctggtcactaatgagcggactttctgaggtggagatgcctgccacacatctccgcagtttgcagccagaaagggcgtgtctgcacaattcccgcgagagagggaacgtggaaacctgggcctgacctctctagtctttgcttatgcatgcctgtgtctcacagttcctgcacagtatcctttgcagtaatatatcttagctgtaagcataactttttgacttatatgagtccttccggtgaatcactgagcaaatcatgaccatgatgtagtcgtgggaaccccaaaatatgttctcagttgaaatttccaaaaaagatttatacatatacatgcatataaaggtacaggattatttctggaaggatcttcaagaaattagtgttccctgatccccaagtgagagagccagtggtgtgaagtgaatgactttttttttactccatatatgtgtttcttttcattgatatgagataatttaaagtatatttgtaaaaaatatatagtagttatactcaatgctttgccatgaccatggagttgttgtcttgaggtaagatgtgaaggatctttaagttgcagtggagaataggagagagtagaaagccatgagtgtgctactggggcttccctgaacctgcaggtgagagccagactcttctgaccttttggatgagatcaagaaggcaggcagaaacaggaaaagggtctctgatagaacagcatgtgtgggaaagcatctatacagtgggtttataagaaagataacaggaatccctcatacattgtatgatgtttataaccttgtaacatttattaatggtataaatataaatataacaattttagttttgcacctttgttttgctagtaactgacaaggaacccacagttgttcatttgttcaatggttttgcagcacttgtgactgtctgtcactttgttgtgactcttctatgtcatgtggacagagcagcaggccgagagccagaagacatggtactactcatgaaggggtcttaacaagaacatttccaacagctagtcacgcaacatgcatgagattcttttactttggttgaaaaatgagggttatggtggaatcgtgttgggcctgagtgatccctaattctctcctgctttttaaattgcatgtttctgctgcaatctcataaagaagaggaaatagcttcactttgccaactgaggaaataatggttcaggtattaagttcccaccaaattcacatttacaacggccacattttacagaattgcatattttagatttttggtgccatcctgatgtttatcaatacagaaggttggcaaagaataatgtttcaatgcactaaaaaaagagaatctgatatggtttgaatgaatggggttaaggtcactatatcttatgaatgaacccagtgatagtctccatagttagatagtattggataatttattatcttaaaaagtatgtggctgggtgcagtggctcaagcctgtaatcccagcactttgggaggctgaggcgggcggatcacgaggtcaggagatcgagaccatcctggctaacacagtgaaaccccgtctctactaaaaatacaaaaaattagccgggcgtggtggcgggcgtctgtagtcccagctacttgggaggctgaggcaggagaatggcatgaagccagtaggcggaggttgcactgagccgagatcacaccactgcactccagcctggcgacagagatagactccatctaaaaaaaaaaaaaaaaaaatccttaaagatagtaccatcctggctgggcgcggtggctcacgccagtaattccagcattttgggaggtcaaggcaggcggatcacgaggtcaggagatcgagaccatcctggataacgcggtgaaaccccgtctctactaaaaatacaaaaaaaaaaaaaaattagccaggcgtggtggtgggcgtctgtagtccctactactcgggaggctgaggcaggagaatggcgagaacccgggaggcggagcttgcagtgagcctagattgcaccactgcactccagcctgggcgacagagcgagactccatctcaaaaaaaaaaaaaaaagatggtaccatcctaggtcatgagaagttccaagtaggtccatggcatgggtgctgaaaaggagcaacagtgaaggtcatttacacatgaaggaattgcaagttcctagcacttaagtgtcatccacaaggaaattgaagattgaggaattgagaagatggtgatggatgtaagaaaatgacccatttggaagatgacacttgctagaaatggtagaggttgctgtaatcagctgatatttgtctaaaaggataagtgagattgtcattttgtttgcttgcttgcttttttttttttttttttttttttttttgagactgagtctcgctgcatcgcccaagctggagtgcagtggcccgatctcggctcactgcaagctccgcctcccaggttcacgccattctcctgcatcagcctcctgagtagctgggactacaggcgcccgccaccaagcctggctaatatttttttgtatttttagtagagacagggtttcaccgtgttagccaggatggtctcaatctcctgacctcataatctgcccgcctcggcctcccaaagtgctgggattgcaggcttgagccacggcgcctagcctacttgcttctttttatgaacaccagtaaccaggaattgatggaaatttaccagaaatgtttcctgatgctatggtagacaaactatggaaataatgagttctacaagggcattgcaaatggtggtctaggcttcagtggagttgaggatgtatagtcaaccctttttttgttgttttattatttttttgtgtgccaggtattagcctgtgcattttatgggcatcatcttatttaatcttcacaatggataccttcattttacagtggaagatactgaagttcagagacattaagtgacttgttaaggcttgtgactggtaaatggtggagtctgcattagaaatccagactgttgcttccaagccatactctcaaacgctatgctatacaagggcattctgtgatgatgttgagatagtcctttttgaaaatgtaatgagttcccagagggcacagaaggaaagagctggaaggcaggaccacagtgaaagggtgagctagaagaatagaggtgcttagagtagaagaaaagacagacttactgaggggtttgggacttgacagagcacccaaaaatggcagagcagagaaatatgggggaggattatgggccttgaggttcagagtggacccttgcagggatggggcttcagtctccacccctgctcatgcccttgcttcctggaaacctatcatgggctttgctcaggttaccccaggactccagaagttttatgcttcttggagtctgtcttctgagtaggagtgggaatgtagatgtggcaaagctgttctcactccagtttggatgccaggtggtaagaagtttaatttttctacaaagtttatgcccttgatttatgaaggggtattgatgtttctcaaactaaggaacccaaaccttttttacgtggtgtaaggacattacatgctgaaaacttgatttttgctttggttccactattaatttgctgggtgactttcggcaggtcacagcttctttgagtacctggtttcctttttttaagctcagaaattcagctgcgtgatctttaagatttcatatgctcgccaggcgcagtggctcacgcctgtaatcccagcactttgggaggccgaggtgggtggatcacgaggtcaggagatcgagaccatcctggctaacatggtgaaaccccgtctctactaaaaatacaaaaaattagctgggcgtggtggcaggcacctgtagtcccagctacttaggaggcaggagaatggtgtgaacccgggaggcagagcttgcagtgagtcgggattgcgccactgcactccagcctgggcgacagagcaagactccatctcaaacaaacaaacaaacaaacaaacaaaatatgtaatatgctctgaagttttgccgacatgaactttcttccttcacaacctgtaccccagccctaggcatcattgttcctgttctgtaccactgcatagaacaagctgcctcctaatttagtgaatgaacacactgcattgatttcatggcaggggatggtgatgttgattactccagattagttctcacttgtgactcctcagatggcagacaaggctgaagctgtcagaaagcttctgcacctctatacctggcacctggaatgctatggattgaagagctaggagctggtcaggtaacttggtctccacacagcctctccatgtgacaagcttgaggttcctcacagtatgacagtcttgggctagtcagagtttttgtagagagcttggctttccccagattcccctgcattccacgagacccaggcaaaagctaaaaagcttcttatgtcctaatcttggaatctgcaaatgcagattcatgggggcacagaaatagataccacctctcaatgggcgaatgacctgatagaaaagaagggaagaaaggagcggccactttgcaggcaagttcatagtcattctgtcttaataaacctcatcccaggttgctaattccaaacaaatttcccagacctaaacatacaaagaggaaggagaaagcaatttaccattcataaatagattgaaattaacattaatacttacatcttcattttattccatgcccgaaggtagaataatttaataatgttaattattttttccagtcatgacttgctgagccaattaatttttttcatttattttctcatttattctttcttcagggtttgaattggctttgttttctgctttttcatatcttgattttagccatattcaatccaattacagttttctttcagtttttactttctttttattgtcaacactttgcttctttgtatattgaatttcccacccttaatgcaaggatgtctagtcagtagctgctagaggtgtaactactgatttattttttcttctgtatggagccagtgtcaagctagtctagtagtcagtctcctaagaaactttattatctctttcagcttcactggctgtattcgctgggaagcagtttaacgacactggctgatcttaacaggttgctataaccacttgaaggcacaataaatgtgggaggaaaatgttctttttcttctctcttggtggaaaaatagatgtataattttctagctttcttttctccatttgggttaatgatatgaagaagatttctgctagtttaagtgtaattaaaagagagagattggtaacctctggataacggtgggcattttgaggattgcactgtgtagagctgatgatgaaagagcttctctagctaatatgtgctcaaacacacagtgacaagaactagaatgacaaaatccaggctgtatgcttctgaatggtatggatgacgagtggatttttcaccacctggtatgaacatgggatgttaggtggagacagacagcagatacctttgggtatctgggaaacttatacctcctgctgtgatggcgatgaagcactcaggccttttgtgttatagaattgggatttgtggtaggcaggattctaaagatggcgctcccaaggcgatatcccatccacctggcatacaaaccctgcctaaccccgggaaccatgaatataatgtgtttgactcctgtaattaggtcatttgtatggcacaattgtcactaagatagggatattatttgagtgcattgacttaatcagaggtgcacctgacttaatcagaactttgaagaagtcggagaggtgagaagcctgagagagttgatgatgcgagagtttctctgctgctgagatgcaaggccgcgtggggaggccttgagaggaatctctggaagctgagaggggtctgcagctggcagctaggaagatggtgcatactgagtcatacaatcacaaggaaacaaattctgctgataacctgaggggtcttggaagcagctctttccctggctgagcctccaagatgagaatgtatccaggcaacatcttgattccaacctcacgagaccccaagcagactcccatggatcgggagacatatgacataataaatgcatatcattttaagccagtgagtctgtggcaaaatttgcagcaacagaaaataaacacagcaaccaccccatttatgaaaatgcaccttagaatttaattttcataatttcatagagattctgcgaatgtttttgtattatgaaagtgattcagctgttctcactccagtttggagactttaggggagaattcctatactgtaacttatgtttcgaaatattctgatgggcacgtttgagctctgtaagttcttcctgccttatttccagctgtgtttcacagtgattgcacagacttcggtccctgcaggattggccttactattgcagaaagaaaaacaccagattcaaaaactgtcacatgacaatgataacaaggtgccttcgagatgcaatgtggtcaggagtctcacgtataaaaaggatccattcattgactctttataattggagattcttctacaaaatgcttcagttttctcccactgatgagtggtgtctgtttctctggagagtgcttggagaaagacaatgtggagtactgtggaatattgatggatgttgtacgtttatagctaaagcaaccttccctcatgccaccagcatcaggcagttcatatcataagaccaagcacagaacttattttttcttcatgttttctcccaacaccgaggctttttcttctgctatgctcctctgtcacctagctctgcaacttccccaacttcttgcaccctcttagtccctgttctctctatgaccccacctcatcgcttctccacaataacttcctcatacaattttcatgagggtaacctagaagagtgacaggtacccaaagcatatactttatgctgagcatttgatgtcatccaatgtcctttccaaaaggaaccatttctgctaggttggtattctccaaagcccaaaagtccttagaagtgctccatagtgcctgggcatggtggctcatgcctgtaattgcagcactttgggaggccgaggtgggcagatcacttgaggtcaggagttcaagaccagcctggccaacacagtgaaacaccatctctgctaaaagtatgaaaattggccgggcgcgatggctcacgcctgtaatcccagcactatgggaggccgaggcaggtggatcacgaggtcaggagattgagaccatcctggctaacatggtgaaaccccgtctctactaaaaatacaaaaaaaaattagccgggcatggtgacaggcatctgtagtcccagctactcgggaggctgaggcaggagaatggtgtgaaccggggaggcagagcttgcagagacccgagatcatgccactgcactccagcctgggtgacagagcaagactccgtctcaaaaaaacaaacaaataaaaaaaacaacgaaaattagctgggtgtggtggcacatgcctgtaatcccagctactcaggaggctgaggcacgagaatcgcttgaacccaggaggtggaggttgcagtgagccgaggttgcaccactgcactccagcctgggtgacagagcaaaactcaaccgcaacaaaaaaagaagtgctccatagtgtccatagtagcggctgaagtgagttgtgaagactgagctcttatggagcagcctctcaggccctcaggccccatgagcccaaatctctttctgggagattcgaagagatgcacaggtcactccatcaggtaatggggcaggtccaataaactgtaacctcatgcaaccagcaatgcctgagaagtgggttctgaaagggctcagcaatctcatgtagcctctccaggactctctcaccttccttcacagtaagtcctttgtgagtcaggctcatataaggagaatgtgactttccttacctcagctcttcacacctatggacatctttaattgttactgcaaattgaccacaactttgttgtaactgtagcaatttgcaaaagaagtgtatgtgtgttgggtgatgggtgggtgacgggcacctggttttgcaccaggaaataaaataatttgcaatttcaggtctttaaagaatgttgagtctatgatagtccgactgacgcacagacgttagcccagaaagactgtggcagacctctgatttacagagctgtaagatggagtgtttcctggcctccttcgccacacgttctttcctcccttttctgaacttcccagcatgaggtttgcctacatgcctatgtcaggcactgagttgtgacaatcctgaaagtgaggtccctgtctctctatgcctagtatgctatctcaccaaagtcagtctttcgaaagtatgtgaggatttattgcattccagttaaaagcagctgcctcattatatgaaatctttttaatttattctttgtttgtttgtttgtttgtttattgagacagagtctcgctgtgttgcccaggctggagtgcagtggcacaatctcggctcactgcaacttccgcctcccatgttcaagcgattcacctgctttggtctcccaagtagctgagactacaggcgtgccccactatgcccagctaattttttgtatttttagtagagatggggtgttacaatgttggccaggatggtctcaaactcctgacctcaggtgatccgcccacctcagcctcccaaagtgctgggatcacaggcgtgagccactgagccgggccccattataccaaatcttaaaacagataattccctgtgtatagagcatattgcagctatgctcaggggagatgatattcctagcactaaattaccttttttgaactattgagtaaatgtagtctcaacagtgcaatgcttaaagacaaacactattttttatttcttgcaaaataatattttattcacaaaatatccattataaggctgaagagttcaatgatatccatatggtgaaatatgtaaacaaacaaatctttatagttgctaagagcttagcgatgcatttacatgctcttccagcctattggcatttaacctgcattaatcacttttgaataattaatactatgatctcccattgttcattcaactcaataaggtgaaactttaaaaaccacactgattaagatcttccaacttgaaaacctctattcttttctctatgttagtttgctaagaatgtgagctactagtttttaaagaaatatagttctagacagaaatagaatagagattgcacacattcataaatttgtctgactcctaacaagagtaccttgtcaagggtaatatggcttatgtgttagaaatataatttaaaattaataaaataccaattttatcacattatggtaatgtttactgctttcctgaagtgtttgagattttcctgtagaatgtacttggagcatgtacagttacacaatgaaagtaataaactattaaatcaaaaaaatattttagaaacactcagtatatgaacctcttgctctagcataaactatttatatgttttacatccggtgttaggacataggcatttttcttacagaaattctcaaataaggacaaaacatccccctaatatgtagtagaatgtttactgcagcactgtttgtaataataatttctaaaaacctgacaactctctagaatgttatcagtgagggatagaaaaatcattctgaatccttgctatctagcagggtgcagctgtgagaaagtaggagagaaacctagctacggcgtgacacggagagatcaccaagacagaaatgacatgagagaagaaaggaagtcagataataatgcataaagtaatattccattgatgctagaatgcagccagacaacacagtgtgtttagagaaatttactagctaaacttagacattgtttgaaacttttataaaaatgcatttgtggtctacaaatatgtacattagtaaaaataaaacagcacttattgtgcatgcacactcagtgcatctctctgaagtgagaactcataattttccagatgaggaaactcaggcacaatgaggttaagggatttcacccagagcccacgttcagtgagcagggagctttgtaaggctctggagtctttgttcttaatcattgttgctgtattatgctttgagtaatgaaaacaaatcaactcaggagttttaaccaaaaacatctgttaaagaaaatgaggaggccgggcacggtggctcacaccagtaatcccaacgctttgggaggccgaggcggacagatcacaaggtcgggagactgagaccatcttggctaacacggtgaaaccccgtctgtactaaaaatacaaaaaacaaaaaaaaaatttagccaggtgtggtggcacacatctgtagccccagctactcaggaggccaaggcaggagaatcgcttgaacccgggaggtggaggttgcagtgagccgagatcacgccactgcactccagcctgggtgacagagcgagactttgtctcaggggggaaagaaaagaggagattggatcaggtgaggtctaagatctcttaagcaattacatcttacaggagtgtgagctttggggtcagctggctttgggtgagactccagttttgatgctgacacttgactgtgggcagttaactaagtcccactgagctggtttcgaacccataaaatgtaaagtgtaggcactgctttatggggttactgtagtgagaggggctggtcctgaggcaacctggggatagttcctagcaagtgctcaggaataatatcactttcccccatgactccaaaatcccaggatctttagtcttacctgaatatgtatggagtaaaacatattcccaagttatgagatctctctggagctcagtctttcatatcaaactgctaaccagacacctccacttgcatgagccacggaccattaatactcagtctatttgtttgtttgtttgtttgtttgagacggaatcacccaggctggagtgcagtgacacaatcttggctcactgcaaccttcgcaacttctgtctcctgggttctagcgattctcctgcctcagcctcagagtagctgggattacaggtgaggtgcctccgtgcccggctaatttttgtatttttagtagagacggggtttcaccatattggccaggctggtctcgaactcctaacgtcaggtgatccacccccacgccccctcggcctcccaaagtgcccggattacaggcgtgcaatactcagtctgtttgaaaccagtattacctcctttgttctcgtccaaagctgtcttattctctagcgtcccctatcttgacagcaacatcctatcagttgctaaaacacatattccagactgttgacgctcagtggcactctaagccctgtggatgccacattcttaatacattttgaatgtgcccactcttctctgtctggatgactggcatcttgcttagggtgccatcatccttggcataagtttctgcatcctatgtacgccacctgcctcaagtcctaatcccttcatgttggaattacactgcagtcaggggtatccttccaaaatgtacaccagattctctgaaaaataatctgtcttgctcttaaatgtgcccctcagatactgtaagagctcctccttgcctttggattaaatcccaaattctttatgcccgagttgatcttcaatgtcatctcatattccatgccccttccagactcggaagcagttcatggagcagaatattcaactattcagaaacactgaatcaattttcgctctgaacaagaatgatttttctagcttcatgggctctgcccacaccacctcagacacctgccacattccctttacacccacctatcatttccttactacctgattcttttcattctccagatctcagtaaagaagtcgcttgctttctgctaattttcctaacatctccacatctccatctcatgttcaagacaaaggaggttctcatgtcttcccataatgaactatctcgtactgtccccatcatggcagagcatgctgtattacaagttcgatgtgcaggaaatagggcccaagtggtgtttgccattaatcaatgtggcatatgcagtgcagtactggggcagactcctataaatgaccttttaaaagatgctaatatgacctttcaaaagatgcaaatctgactttatcactttcctgcaagacctttgagcagctttgaacctctttgtctttgtttcctccaaagacaccatccagctccctgtgcagcctcaggcctcagtgacttagcccccgccttttttttttttttttttttttttttttgtgagatggagtctcgctctgtcacccaggctggagtgcagtggcgccatctcggctcactgcaagctccgccttccgggttcacgccattctcctgcctcagtctcccgagtagctgggactacaggcgcccaccactacgccccgctaatttttttgtatttttagtagagacggggtttcaccacgttagccaggatggtctcgatctgatgaccttgtgatccgcccgcctcggcctcccaaagtgctaggattacaggcgtgagccaccgcgcccggcccagcccccgcctttctgacttccactctcatcctccatccgtctctggtataaagttctttcctgacacaaggtctttgcttatgtggtctcccctccccctctctggatttctttcctggctacaaatcatcatttaggtctcagcttaaatgccacttcctgaaaaatgactttgctgagagcctcaattgggtctctcagttctaaaaaccctgcacgttcccatgtctgtgtgtcccccgatgtgctcttcccaattagacagcagggtccccgagtgctgaattttcttcactgctaccacgccaacacctaacaaagaacttgccccaaaatctatttgtcaaatggaagaataaatcattaaggaaaatatctgatcagtgatttgatgataaaaaatacagtatataatgaatacctagaagtttattatagttaaatgggccgtctctgagatggaataacttcactacgatttatgtgttttagaaaaataatgacatataattcacagatttaatgacagtgtcacatctatacttccattttatgtggcatattgtagaaagagcgagttttattatccagattacctaataaggaaacagtgtttaaatgctgatatggtttggctgcgtccccagtgattcaaagaccaaaagggtttaaataaaaagaagaccaaaggaaataaatagaaaagaggagggaatttatgagaaaccattttaaatggtccattttcaaggcatgataaatcaaaagtactggaagccagcctgcaaatttaacaaaccgcactgctcatgcacctagaaggtcacagtaagcaaacaatgaaaaggaggggtcagcccataaaagggaaaaaagtttcattattgggaaattgaaacaagcaagaaagaggaccgagatataaccttataagggggataatgaaacgtaggtgacatccaggaaaattgtaaccccatagcactcaaccaatgaggaacttggggagggacttgcgtactagaagataaattacttgttgtgacggccccagatgtacctacctaccagacacccaatcttgcaagaccattattaagtctcactttcgcttttcttcatgcctctaagtccattctttgggtttggatggatgagtagatttctcacacccactcaaatctcatcttgaatttctacgtgtcgtgggagggacctggtgtgaggtaattgaatcatgcaggcaggtatttcccatgctatctgtgtgataggaacggtgtctcttgcacacagatggtactaacttcaactatgtcaaacaaaaagttgtttgttacttaacagtcatctcatttgctactataccttcaagaataagccactgattcaatttatctaaaattatgatgttaaaataatttttgaagtttgtttttacatatatctgattatctacctacctctattttattttaccaagttaattgctttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaatttttttttgtatttttagtagagacggggtttcaccgttttagccgggatggtctcgatctcctgacctcgtgatccgcccgcctcggcctcccaaagtgctgggattacaggcgtgagccaccgcgcccggccaagttaattgcttttaacttcaatgttcttaaaatcactctgcctcctttgcattatggtataaaaatagaacaatctttttcctattgatttctaaatgcttgaagtctcctctccttctctttaaaacccaatctgatagtgtggatttaacatgcctaccttcaacattttgttatttgtattaagttatttcactttattattttttaaattatatgccttataagtcaggtttggacttttactcctggttgggaattcttaaataaaataaagagtgattagttgtcaaagtttacttcaagcatagctaagaaaatttggcccatagttctttcctcttgttgctataagatctgtgttttggccgggcgcggtggctcacgcctgtaatcccagcactttgggaggccaaggcaggcggatcacgaggtcaggagatcgagaccatcctggctaacacagtgtaaccccatctctacaaaaaaaaaaaaaattagccgggcgaggtggcgggcgcctgtagtcctagctactcgggcggctgaggcaggagaatggcgtgaaccccggggggcggagcctgcagtgagcagcgatcgggccactgcactccagcctgggcaacagcgagactccgtctcaaaaaaaaaaaaaaaaaaagatctgtgttttatctatcaagaagtgtttctcattttcaatctacgagtcatgattaaggaattaatagaagaacacccaatgtccttgttcaacaggaattatcagggttaagtcaaattcttataactcagcggttaattactcaatttttgcattttgttatataaatttttacccggtctactttgcaagtagtttcaaataactacttgcaaagtagtcactagctgttatcaatctattcatgatttgccatggtaatttcttcctatcactcatctcttctgcattgctgagtaaaggaaacagtgatcaacttaaagcatgtggaaaacaaaataaatagagactgagagaaaaacagcaaattttacttgtgtatttagtattttcttcctttctgtggcttgattttatttgatgtttggaacacaatctatttctaaaatttgtggggacagttccatcttttggtttctgtgtttgcatttccacctcacttccttaaattaattttcttccataatatttcatgttaacatatatctaggttttctgatcacacacaaacacacacaaagacacacacagctcttcttgaagtttgtacaccatttacaccatttctctggactgttgagtctattatgattgtttacattgagggatgaatttttgaagacatatgaattgaaacaaaggtcagtggaccaattcagtgtcttgcaaagttgtttattataatgagattattatcagggctttaagccttttaggccatgaggaacaattaatggcactccaaatttacattgagtaaattaatatttgtaatactttatatatcttttgccccccaaaataaaataatatagtattaaatcaactcaagagaaaattttaggaaacaacatgtttatagtagacagaattataagatacctcctcccactgcccatgggcaagattttttaccctgttgtatacacacctactcccagtttttcaaacactgatatagatactgctgtgaagagattttgccgatgtaattaaggtcctgattcactgataaggagattatctggatggaccctaacatggggagatttttctaatcatatgagtccttacaaagcagaaaattttctccagctgatgtcaaaagaggaagtcagagattcaaaacacaagaagaatttgacatgctattgcagttttgaagtaatacagtatcctctaggatgtgacagtggcctcagtggacagccagtgagcaaacaggatcccagttctacaaccacaaggaattggattctctcaattgtgctgataagctggaagcagattcttccttgctcagtcctccagatgaaaacagcccacagcagtttgatttcagctttgtgagatgatgagcagagaacccaagcaagccacaccagatttcttttttttttctttctttctttctttttttttttttttttttttgagacagagtttcactcttgttgcccaggctggagtgcaatggcacgatctcagctcactgcaacctctgcctcctgggttcaagcaattctcctaccttagcctcccaagtacctgggattacaggcacccgccaccacgcccagctgatttttgtatttttagtagagatagggtttcaccactttggccaggctggtcttgaactcctgacctcaggagatccacccgcctcggcctcccaaagtgctaggattacaggtgtgagccactgcaactggcctcaccacaccagatttctatcctacaaaactatgaatttataaatggcttagttggaacctgctaaatttgtagtaattggcagtacagcaacagaaaacaaagacagattttataattgagactaggagtggcttcataattaggcagtggaaggaagacagaagaaaatgaggaatatgactcagaaaccctaagttacctcagacaacacctaaattgttgtgcccaggcaactaaaactgtgagataatagattcgtattattttaagcagctgaatttatggtaattcattatgcagcaacagaaaatgaagacagcgcctataatatgtgagactaatacttcattgtaacatgaagcatttcatgctacaaagtactcagatgctggacaaattatgacatataaatcttaaaagatattgatgagcttccaatccagtaattataagctccacccacctactcactctagggacttgatatggtttggctgtgtccccaccgaaatctcatcttgaattcccatattttgtgggagagacctggtgggaggtaattgaatcatgggggcaaatctttcccatgctgttatcgtgatagtgaataagtcttacacgatctgatggttttaaaaagaggagttcctcatggacacacggaggggaacatcacacacccagggcctgtcatggttgggggaaaggggagggagagcattagaataaatacctaatgcatgcagggcttaaaaacctagatgacaggttgataggtgaagcaaaacatcatgagacatgtatacctatgtaacgaaactgcatgttctgcacatgtatcccagaacttaaaataaaaataaataaataaataaatacatacacatatatgcacaacaaaaataaaaataaagcacaagctctctctctttttgcctgctgccatccatgtaagacgtgacttgctcctccttgccttctgccagggttgcaaggtttccccagccacatgaaactgttaagcccaataaacctttcttttgtaaattgcccagtcttgggtatgcctttatcagcagcgtgaaaacagactaatacagtaaattggtaccagtagagtggggtgctgctgaaaagacatccgaaaatgcggaagcaattttggaactgggtaaaaggcagaggttggaacagtttagagggctcagaagaagacaggaaaatatgggaaagtttgaaacttcccagagacttgttgaatggctttgacaaaaaagctgatagtgatatgaacaataagggccaggctgaggtggtctcagatggagatgagcaacttgttgggaactggagcaaaagtgactcttgttatgttttagcaaagagactggcagcattttgcccctgccctagagatttgtggaactttgaacttcagagagatgatttagattatctgacagaagaaatttctttctttttttttctgttaaaagaagtgttttgtctcgttttaatatcttatcagctttacagggttacaatcgtcttaaatatttctgaagttaaaatacaatctgcataataatgctattataaaatgtaaactttcagcgttcttttaaatttcaaaatcacaccttttttctggtctttttgtctttttttattttttttcctttcaatacctggatgttctgcaaaaactgaaattgttacaggccaccctgctgcggccagggcaagaaaggctgggcccagccagaggtagagagtagttttatgattcttttattttttatttttttaaagtctatttttttttcttccattacctaagtttcaggcgtggtccccacatcctctgacaaaccccagagaaactgaaatttcacacgtcacgaatgaaaggctgagtttacgtttgccaagaaaaaaaaatgcaaaagcacaattaggggaaaagagggacaaagtgggtaaaaaaaaaaaaaaagataaaggaaattcagactgtacagatgcgtgacccttaacgaccccggctctccccagtgccccatgcccaccctcccgcctgtcctgacggccacttaagggtcccactgaagattccagaagctgcctgtcccccaacatctcagagcagggagagcccccgctcggcctcgagtgtggggtccccgcccagtacacagctagccccacggccccaagagaactcgaacccgtccagggtcctcgtggctgagggaggtgcccgaccccatcccagtctgcataagaggggatgctgagctgcaccccagaaagccaccccaactttaaacccccaccgacaggcagtggcgggagatgggtacggctggggttgaatggggccacctgaggcagggagtaccctctggaaaccacggcttcctacccagtatccaggaccgggccccacagaccccctgcgaccccctcccatttccacgaccactgccttcagtgatttccttctcctggagtcgccaggccgcccaggacccagccccgtgcccacccacctcccgccccacctgtccctacaatcatcgaagttaacagcaggcccaagtcccctgagttagaatccagtcccacccacagccagggggccggatcgcccacacaggcacgacacgcaggattcccgacacacacacgtacacacgggagcgcaacacacgcagccccagagagacgacccagcccacggccctgcgcagcccctccccagacaccgaggcgggcgggtgcaaaggggcccatggccccctccagggccgccagatgcagcaggcaaccaggccccagtggctgctgcagaccctggtgcacgggaggcgggggagaggcaccccaggggctcagattttggcatcaaaagtcagacctgaggtagacagagataagcagtaggcgcttcccccagcgcgggacccaggcgcgggacggcggctctggggagaggagccctggaggccggagggcagacacggacagggtccaggcggttctgcgagtggggcccgattgcgtcttggggcgaaaagacacccccttcccggggtgattgtgctgctacggtgccggccccgggaaggggcagggagaacctagctgcccaccaccccctcctggaaagggggtgtgtgtcaatggccctgagatcagaagaaagtggggtcccgtccccaaagacaaaggaaagtgaaagtcccctcccacagcccgacgggagagtgaacctagactcaggggctcagaagccccccagccccctcccccaggggtctccaaggctatgcggaggttgggcggttgggagtcgggggagttggggagtccccttcctcaccgacccccaatgccggtggcctaacagggctcccagggcccaattagagacccaggcttaccatgggaatagctgagttaatccccaccccaccacaagagaaatgaaagcccggagctcccgtgtaggacgcgacagcccagccggtcaccaggcgggtccaacaaggtccccagaccctgccgagcatttcagactcctgcctttctgctccagcagctccagccaaaataacccccagctcggctgctgtaaacccactttctcctaggctggcagaggggcactgacccacagggttggggggcagcctcccttctcggcctcgatttagtcaccgcacaactcagggagctcgcagccccggcacaaaagcggtcgggagaagaggaagagatagaaggaggagaatgttggggtgtggggtgtgttcagtaagccagggccccgaaatcctcaccctgagctaggtctggcttcacccccactccccagtattgttagtccccaaaagcagcccttttggacaagagaagaatcccaatgagaaggccacattcatccctgagacaggagcctgggggctgtgacaagaaccacccccgccccccaggccccaggccctttttccagcagttgctactttttagataagatttccaggccgggccgggcgcagtggctcatgactaatcccagcactttgggaggctgaggagggcggatcacctgaggtcaggagttcgggaccagcctggccaacatgacgaaaccccatctctactaaaaatacaaaaattagctaggcgtggtggcgggtgcctgtaattccagctactccgaaggctgaggcaggagagtcgcttgaacccaggaggtggaggttgcagtgagccaagatagggccacggtactccagcctgggtgacaagagggagactccatctcaaaacaaacaaacaaacaaacaaacaaaacaaaacaaaacaaaaacagaaaaaagaagagctaatgaggaaattaaaagaattgtaagaatctatttagcttagttattcaaattagtttgataatcttaataaagtatataattttccaagaaaatataatttaacaaaatgaatcctataaaaattagaaaagtctaaattgactgacttccatgcaaaagacaaagaaaaatgtcagtccttcagaatattaggtggccactactttctaagagaattgtatcgctcctttaaagagaagtaaattccagtgcagtctatactattccgaagaattgaaaactgataaaagctttctaattcattttatgaaataagtacaacattaaagctaaattacttttaaaagattaaatacaaaaaataaaattacagttacaatctcagttaaccatgcaaaaaattctaatgaaatagaaacagccgattagcagaatctgcttcatgatcgctgcttttagtctagaaatggttggatagtcttatgttaaaatatatgaaataagtttccatttttatttgcagtcgatcaaaatctcaatggagaaaaagtcaaggccttgtctaaaggacaaaagaaattttatgatattgttctgtgtctcaactacctgtttactctttatacagtaagggcagaaaggggtgatacctttccaaagttccccatcagaaaggtcacaaccagtactcctataacaaaaggcagtttaaagaaaagtatagcaaatcaatttaatcaaagttttacatgtcagaagagccttcaaaaatgaagaaccaaagacccagggaaatcatctatttttataggtaggcttcatgaagaagggacagcgatgtggaaatgtgattggacaaaaaggaatgatcccatggtaataggctgagaaagaacccagcaagacctgtcttcctggcctctaagctgcatttatttctcctggtgtgggacacacagtcttcaagggagaaggaaaagaatgacttttctaggttttatgacttgctttggggaagaggggctctagtttctgtgacttgccttggggaaaaggaattctggtttcagcttcagagtaatgagaggggagggagacaggagggcaggagaaggtcagcgaccttgcccttgattctgaagcctccagtctcctttagttcaaagtattcagcaggccaaggtgccatctgttggagtattgtgttctgaaccccaacaacatcacttcggaagactgaaatggcagatgttatatgccatggaggataaatattgctattacaatctaacagtaatactagccaagatgaaaaagagaaaagaacataccaaaataacctagactatatctcaaagcaaactttttataattagctaaattgtaaaaatagttctcatataaaataaaaccttactattcttatttaagatacttgtaacacaaagataactgtactgtcataaatgtgacaatattgaaggccctgctccaattgttcttatgttattatgattaataatcacttttaaaaatcacttatatttgacatagagatttttttctattgtgcctaattgttctgtagtgtatgaggagaaactgtccaatcaacagattatttagatgtaatttgatgcttactcattgtgtactcggtaaatgaatttttagaagtacattaacaagatgtgagaaaacacattaaattttcaaaagaaaactacacaaaatagacaagattttttaaatcatggaagtaaatattttacattatatataatgtgaatgaaattcatacccgtagattcaaatgtttgtgacttttaaaatcaaattaaacaaattgagaaaatatgtaatgccattatattgacttagaacatgtcagttgaaaaatagcttcctattttatttggtttctctggcatctatataaatgtatgtttaaaggacaattacctttccttttccctttttatttctgaagtatgaaagacaatgtgagatttttctgggtaatatgagcttctttgtacatctttttcaggatgccactgatgttgacagctattcttttaaaatactgatattcaacatgacaatgcatgtgacctgccaaggaattgagaagctgaaagtacagtgacatggttatgacagggctgcaaaagacatgacttgtaatgtcatttcaaagctttctctaaaaataagttgaaaaacacaaaatgaatttgccttttattcagccaaaatgagtatctctttacttcagatacctagtttgtattggaagtggtttttgaagattctaaaatgtgtgtgtgtgtgtgtgtgtgtgtgtgtgtgagagagagagagagagacagagagagagagagagactgtgactctgctcaggggttataaatcatttaccttgagtagcatattttctttagtctttgcaactagctgaaggatatcataacttccaatatgatcatttcataaaagttgtctttaaataaacaaaaagatggagtagacgttgaccaaatgttttgattatcatatgtttttaaaaaaggaaacaaaatggacatttatttgttttcataatgatacgtgtaagataggagcagtaaagagtagggtataagacaaacttctagttggtgtattttagaaaaatgttagctaacaatgggatttaacatattaacctctgatactgaaagggaattccatttctggtggtatgtttttccttaagtgaataggccagagataccctcatactaaaaatgtatgtgtatgtataaagcttcatatattttaaacaccttattcagcatcatatttatacttggatagttttcactgtttttctaggatctactgaagtgtttagttttgatgaaagaaagtctatgggtttgatcagaagcccatgagtccaatcaaaggtattatttatttgaaatttaaaaaccatgcaagcaatttcaagcatgtaaattaactaggattttaggacgacctgtgagtggagaagcacaggaaaactaggttatcagaaattcataggagatcctcctgaggcagaagtaaaattatagttgaggagaaatataagtcatcatcccagattaatttgcttgcaatttgaaattatggaaagaggaaaagtccatgtgcaaggatcttcttttccatgcaatctaatttttaaaaactgggataaaaacagcatgagagctaccctcttaaatttttaggaatacaacacagtgttcttaactacaggcacaatgttgtacatagcagatctctaggacttattcatcttgcatacctgaagctttatacttgttaaaagtaactccctattttccacttctcccagcccctggtaacccactgcactttgtgcttctgtgaatggggttattttatattggacatataataacggactcacactgtattttccttttggcttatttcgcttagcataacgtcatcaaggttcatccatgttgccacatatggaaggatttcatttcagacaataatattttgttgtaagtagatgccacattttccttatctattcatatgtcggtgggtctttatgcggcttctacatcctggctatcgtgagtactgctgcaatgaacatgagagttcgaatatgtcttcaagatcttaattttttgaataaataccaagtgtgggattgctggatcatacgatagttctatttttaatgtttttgaggagcctccatactgttttctacagtggctgcaccattttacactcccaatagagtacaaggattccaatttctccacatctttgctaacacttgttacctttttgttgttgttttgacaaccagtggggagtgatatctcattatggttttgattggcatttctctgattagtgacattgagcatttttcatatgtgtgttggctactcggatattcttttagagaaatgtcaatccaagtactgtacaccttttaaaaatctgggtatttgtttctggctattcagttgtagggtttccttatatatgttggatattaacaccttattagataaatagtttgcaaatattttctcctattttataggttgccttttcaatctgttaattgtttcctttgctgtcataaagcttgaaccctttctgggtttaccctacagatatcttttcattatgaatcttcttaaatgatttcatttttatatgtacaataaaaatcaatgagaattgttaaaaacaaaaacctcagagagataggattttactccacagagaacaaagtggagctcatatcaacctgggattaataaaaggaaaactcttttcactcagataaaactctcaggcaaggcatttggaaatatttttgatgcattcgttatctttgaacaatttaagagtatatttatatcacatgttcttacctacaagtggaagctaaacattaggtacacatgtacacaaagatgagaacaatagattctggagaatctgaaggacagaaaagagggaaggggcaaagggtgaaaaactacctatcgggtactatgttcactatttgggtgatgggttcagttgaaacccaaacctcagcataacgcaatacatccttgtagcaaacctgcacatgtacccccgctccaaatctacaataaaaaatagaaatctttggcaaaaaaagagtgtatctacagctcttaagggctatgtttatatatctctattgtcttttgctttatattttgtttatattttgacaatttgtgaaataagtacatcttttaatgctctttatatagttctaatgtaacaacatagctagacaccgttctcataaaaacaaggacaggacattcagaggtaacaataatgagcaaaggtaacatttcaatggaaactgagctaaatgagtaaaagcaatataaatgatatgtaaaggattacaaggttgataggatattgtgttcaagccctagataaatccaaccaactaatctttgagagagaagtatgtagtatggaagcatgtaactgtaattattttgagaaatgctaaacctcaaaataaaaagtttttttgcacttgtcataattgaaagtttgtttttcctctctttttggtaacattctatcactctcgcctgcaaccaaaatgaccctcaccctggcagccagcactgggattccatcctcatcgagctccttgacacgcaggtcggcttcactgtgggcaagcacaatcatcatttgcagacaaaaggagaacccagttatttgatcttgattataagatgtgacaattatctctcaaatattacagattttatgtcataaattgctctggggcactgcaacctagcaagtcctcctgagaggcccatctagcctgctgcccaggccacaaccaaccttgccactagccttttcatcaatacaaaggacaactatttgtaattgtcctccaattgaaagaacatgcctaaagttgtcaattgtgtttatatattttaggtaggtaggtaaagaaaagttcttgttgttggtgaatcacagacaattgttcaatttagaggagaaggcagcctgggtagtggagaggaggacattgttttcattgttgtgtacccagggcccagcatagagacgggaaaatagttggcatcagataaactactattgaattcaattatcatgagattcctttgctaatgctgagaagtacagaaggtagagaagatagaattttatgcttagggaaataaaagactcagaagggtttgccttattgagacccacttagatttgaaagtcctttaagataaatatcattgaatttgacctaggtgagcgtttatattaattctaggcttacaggtctagaagaagcctttgtaaagactttgacatgtccgagtaagattgaaagtgccactctgaaacctactccatagcctcacttactttacttactagaaaacatgttgccctcttgttccactcttcaaagtcaaagaccttgtgacttttctgagccctgaggatgaggatgaggtttccatcacttttcaactttgtatatagaacagagcaggatatttgctgtccagtgaacatcaacatatttcagcaagcctcatctttgttctcattgatggaaagcttaaattaaatctttctcagccagaacattcaacaagggatataataaatgaattatgtaaagaaatacacagatgttttaaacaaaacttctctatggtctcccacaaacctcacacataaatagaaagttaatcatttggtaataaatgaacactttaggtaatgagagatactcaggatccctgaagaaattaaattcttattttctctcttttttttttttttttttttttttgagatagagtctcactctgttgcccaggctggagtgcagtggcgcgatcttggctcactgcaagctctgcctcctgggttcacaccattcttctgcctcagcctcccgagtagctgggactacaggcacccgccaccacgcctggctaatttttttgtatttttagtagagacagggtttcaccatgttagccaggatggtctcaatctcctgacttcgtgatctgcccacctcggcctcccagagtgctgggattacaggcatgagccaccgtgcctggtcagattcttattttctcttaaaaagacagcatgccctgggcacatatggaatgccatgtccaagcacacacccagctccatccccattaggagtcacaattagcacattgctgttgacaagatcaaacacagacctttcccctttggcctaagtctgctgacaaggcaaaacacagatcctccaaccacccattctttgtctcattattaattagctaagattagaactgtttgtccctccaaactaacaaaatcctaagataaacatttcctgctgagttgactaagacccccccgattgcagaataattttgatagtaaattataccaccagttgaacagtcacaacctgctgagatctggccatgttctctctattacaaatagtcctaatgaaatcatatgctccacagtccagtgcattttgtctttgagagttgccagcctcttttactggagttgcagctcacgatgtagaggaagctactctggggactttggtcattttgcactttgtaggaattgtgctcagtaagtgattgattcacttatcatgagagataataggcaaataaaaagaattcttatacttttgatggcagctaattgggttcccaggttagtctggcatagtggaaagagggttcctgggttctataggctgcagacatgaacctccacatttgctacttgtctccttcaaggaagtcacttcacctccctaagcctcaggtattcaatttgtgaaatgataggtgctagatttctaatgttaacactgtggagaaaaactccttttcttagtagaaatatcttccatactcccaaaacacacacactcctgtttctcttcaggaaatgcttctattgacctgttagaataggagctgaaaccccaggtgacaattttgaataacgatataagaggttaatattctactttagatgatggaggttagaagcaagtcagctaactgcagagctgttgttttgctgattggattcaagtagagtgacagatctgagtaccttgggacaaaatgagggcatttctgaggaagcagaagtctgaaagaaaagaaagaggagaagtcatgggaaccaccttctcaaattatagttccttttggctagatacttagttaactagtgtaacagtaaatacaaatggaacataggaaaaaaataataattctccctgatggaaaaagggaaagagatctccaccaccaccaccaccatttcctcagaacattttctttcagaaacataaattctttctctgcttcttagggatatagcaattttttaaagaaaaaagataagtctcttgcaggttttacaatgtaggaatgtgtttctcaagggtctggaactatctctgagatagaatcaccaaggaggattgtacctcatcccctcatctttataaaccaaaaataaaactcatagccaccccctccacccctcacaaacatctgaatggacccctcctctgccagggcaccctaaatttaacctgaaagactggtttaggccatgatggtgagacagccaggtgggagagggtccccagtgaaactgcaaccagcccacactggaaggaatgcaccttggggtggagccacagaagtttgcactgtttgcagagggaggagcctggtcccacctcttcctgtgtggaaactgggattcaatctgcaaggcaggaagcacaccagcagagactctgactttgcagagggtccctgttccccctttttttttccttttcacccaataaaaccctgctttactcacccttcaactcgtctgcaagcctaaattttcgtggccatgggacaaagactgcatctttagctgaactaaggaaaagtcccacaacaatggggagggagggtcagatatgcctcattatgccctctttcctcttggaattcaggaaaaaccaatcaccatttaatatcaacacaagccttaggtctgagaagaaacctgtacaatctattttctctgaagcctgcgaaatggaggcttcatcttcatgataaaactttggtctctgcaacctcttatcataacccagacattgttttctatgataataactctttcaagcaattgccaatccgaaatttttcattctacctataacctggacacccccttgctttgagttgtcccacttttctggactgaaccaacttatatcttaaatgtatttgattgatgtctcatgtctccctgaaatgtataaaactaggctgtgctgcaaccaccttggacacatgttctcgggatctcctgagggctgtgtcatgggccatggtcactcatatttggctcagaataaatttctacaaatgtgttacaaagttggactctttttattgacattttcatgggagggtaggaacctaatgttacctaggcgtcgggctccacattgcaaaactacctcctggtataaagatatgagaatttgtttttcctttcgataaaggtaattagcaagcacccatggccaatttcaattacccagtgaatctgggatgaattctatgtggcaagtggtgctgtcaagtccttttactaacttgcaaactacttatcatcgatcttgagaacgtgtatgtgagggttttacctacttggccacatgaaagggtgagatttctgtctgtttttcaatctctttggcagatttcttgtgatgcacattgaagtgagccttagtgcttattcaacaacatctattctacttttgtggagaggtttcctgaacaggttttgttttaaattatttcccaaacactagatatttgctatctagtatatctttgctaggctgcaaagaaggggtcagcaagctttttctgtaaaggcccagatagtaaatatttaggctttatgtgtcacatacagttttaggtcatattattttctttgctgtttttttttttccccagcctgtcattaatgtaaaaaacattcttagcttgttgcccaaatgggcactggatttggcccttggctccataatttgccaactgtaaagtgtgggaggagattgtgaaacccttcccagagaggcctgtaaggggcaccttcagagggtgatgctacctttagggaaacaggtgactcagacccagtcttttatttacttccctagccactagagtttggctccatctctgtgccaaaggaatgcagtgaagagagaagagaggtattcaaaggtgacatatacagttgattctcattattcacagtagttatgttctataaagtttctgtaaatatcaaattactgtaggggcagagagaaatcttcccctctgccctctgatagttcactgctgaaatgagctgacaatagacagattaacaagggaaaaatgcacacaatttattaatatgcacatggagatgggagtcctaaaaatatgagactcaaagaagagctttggttaagccttaaatgccctctagttggttaattcttaaatatcctattcacaggggacagggaaaagggggactgtgggcacatctagagggaaagtaaattattttagggaaaatgaatgagctcaaagaaaagacaattggcctggtacaaagtttgtctgagctctgggggaggtacaaacaaattatggaaaggtgagaccagaacttcattgtaaacaaaggttgtcattaagcagataaaatctttcccataatctctctgagctgccctcagaaggatagatgaaaagtctgtctggacatggtaatgacttattttctcctctctggtggttactctttcctggttatatgataagatctgtagagagggagttttaaaacatctgcatttctggcccggtgcagtggctcacgcctgtaatcccagcactctgggaaggccgaggagggtggatcacgaggtcaggagatcgagaccatcctggctaacatggtaaaaccccgtctccactaaaaaataccaaaaaattagccaggcgtggtggcgggcacctgtaatcctagctactcgggaggctgaggcagaagaatggcgtgaacctgggaggtggagcttgcagtgagctgagattgggccactgcactccagcctgggtgacagagcgagactccgtctcaaaaaaaaaaaaacaaaaaaaacaggccgggcacagtggctcatgcctgtaatcccagcactttgggaggtcgaggtgggtggatcacaaggtcaggagttcgaggccagcctggccaatatggtgaaaccttgtctctactaaaaatacaaaaaacttagccaggcatggtggcacctgcctgtaatcccagctacttgggaggctgaggcaggagaattgcttgaatccaggaggcaaaggttgcagtgagccaagatcacgccactgcactccagcctgggtgacagagcgagattccgtctcaaaaaacaaaaacaaacaaacaaaaaaaccctgcatttgtatatgtcaatttgactgggctaaattaaaacaaacaaacaaacaaacaaaaacactgcatttcttctggagaaacctcccttggtcagacttaatcagataaggaaacttcagcaaaagcctctcctttcttgcttccttgcttcaggaaagaaagaggatggtaggtgatatggtttggctacgtccccacacaaatctcatcttgaattgtagctcccataattcccacatgttgtgggaaggacccagtaggaaataattgagtcatggaggctgttccccccatacccccatattgttctcctggaacagaataagtctcatgagagctgatgtttttataaggggaaacctctttcacttggttctcattctttcttgtttgctgccatgtaaggtgtgccttttgccttccactgtgattgtgaggcctcgccggccatgtggaactgtgagtccattaaacctctttttctttatcaattactcagtcttgggtatgtctttatcagcagcatgagaacagactaatacagtagggtggggttgggggggctgatggtgttagacagagtgttggtcctgaggcttatttctgaggcctttcaattttatttaattcaaagcactcaacatgtcaaagtgccatttttgaggatgtggttttcagagctccaacattagcaagtattaaattgttgcttcttgggaaaatgtaaggggaagtttctgtgagcctctggctgcaacattttcatcaaatgatcaagacataatcttgttttatatgtgtttctgtttaaagacaccttatttaacatataaaatttattcatcagcattgagattatagccaatggcactataggtcatatctgaacaaagtttatgtcacatgtgcctccataatgcacatcacggtctttttgtgctttgagagcactttagcactatgtttgggggccattgtaaacatcaaaatcaccaaaaaagcataaaaatatgaaaaccgtgacactaaacagattgtgaaaaggacacttgattttagtatgagagttgaaacaagaaggcagaacacggttttgttcaacatcagctgggaatgtgcaagctgggagaatgaaatttttggccagtctgtgtatgacaacaaaggtgctgtgagtgtgaattttggggctagtaataaattttagcaggtgggtgaatttgcaaatacaaatacattttagcaagaaggtggatttgaaaatacaaaatccacgaataatgagaattgacattctgtgggagttttattgaatgtgaaatgtaaaatctattttctaactattcacaactacttatgaataatgaattcatttccaaatatgtttctgtaaagagtgtatatatgttggggggggtgtccctggaagtgctgagtggaacctccatttgggtgttattgtcacctgacatttcagccccacttttgggttatatcacataatcttaagaatttaaaagaatctaattaaaatatttgtatgttaatgtccatttgaggatatttcaggagtaagagtgtgtgtggatttaaaatgtcataattcttggcttggattattacagtcatctattaccatatttagaataatagctatgacaagcttctgcaagtaggtcatgtttgtgctaattgcttgtcaaagctgtatccccaattatcaccaacataacatgttgatgagacaaagttgattgctaatttattgcaaagtttttttgtttttttgagatgaagtttcgctcttgtcgcctaggctggagcgcagtggcgcagtctcggctcactgcaacctctgcctcccaggttcaagcgattctcctgtctcagcctcatgagtagctgggattacaggcatgtgacatcatgccgaactaattttttgtatttttagtagaggtgaggtttcaccatgttggccaggctagtcttgaactcctgacctcaggtgatccacccgcctcagcctcccaaagtgctgggattataggcatgagccacagcacctggcttattgcgaagtttattgcttacctatgtggcaggaaaataattgacctcccaaagatgtccacacactcatctctggaatatgtgaacatgtgaacttacatgaaaaatggaaattaagaccacatttggaattaaagttgttaactcactttgaaataggcagattatcctggattatccagatggggctaatcacaagttcttaaaagtggaagaggggggcagaagagaaagaaccaaagagatggcagcgtgagaaggcctcccagcctatcattgctgactgtgaagatggaggaaggggccaggggctgaggacagcaggcagcctctagatgctggaaaagtcagacacaggagcccagagcctgcaggaggaacctctaccctgctgatgcctggattttaggtcagtgagacccacattgaatgtctgaccaagaggactgtaggataacaagtctggattgtttacaacactgtttgtggtaatttgttacagcagcaatagaaaactaatacactggcaagggagagagtacagcctttgtaaatttctatcagcatctcagaggagagaaggggagatcagaatttattgagaattgcaagtttggtttaagatgggtctctgaaggagaggatttgattagaattgtgtgagaatcatgatacaacagtctgggcttagagaaaatagtgaggtgaggatttgtggggaaggattcaaagactcaagctgtaaactcggtctatgacttcccctgaaggttgataaagcatttgggaagttcctataatgaaaaatcaaaccattctttaggtaggacagtccttgaaaagtaatactaatggaacaatagaataacaaagtcatgttaatatcagtgggaaggtgtggcttcggttctcagtgtccaggctgaggtggttctcttggctcttgatttaatagctgatcttctatagaaaaatgtatagctgtcactgccctgcttcctctgtgtactaatttatgactatgctcaaaggcacaaaagcaatacaagtatgatctggatagaaaaaaagaagtatttggcagctaactatgaagaaaatagactattctgatggctgctttcattactatcactgtgtacattgctgaaagtagaacgtgagcagaaaataataattttcgaatttaaaacatactttgctgtctacttatgacatgctaataaggtaacaaattcttatcaatcatgtctgaaaaggacacaaatagaacacagtgcttgccattttagtgattgtcagatttcttgtgacaactgagaatgttaattttatagtaaacttgccattactctgtatgtagttcatcatgatgtcttctgaagccctttcagtcatggcctagtgttaaataccaatgcaatgctgctttgatcaatgcaatgcatgcagtgcccataaaactaatgtcttgtaaaactactttgtagccagaaatctttaagacgttaccagtattctgagataacacagaatactctctcataatttttaaatctttaaatattagtttcaacatcaaacacaattcattatggtaccacttttttttaacatgattaatttgatagctaatacaaatcaatgtgaatgtaaatatataagaaatgacataggtaagacaataaacatctgattacttgctcagcaaatattttcttaccaacgttacaaacctcttttttttgcattattttgaaacatttacttttgctagattcagtgaagcaagtaaagtttgaatttgaaaataaactaaactgtgatttgtggaacaggtttttatttcacttttgaaataaatgacacatactgcaattaattaaatttgagataatttgattattaaatttgagataatgactttgagcaaacttatcaaaatttattataataactcttttaaattaatcgcatttttattcatgtgctatgttaaaccacataatcaaactgaaactttaagaaagtacacaggtcccagaacagagcagtttttcctcaagacaggaaattccggtctacctgagtcagtgcaaaaaggaacttttctctgctttaacccttacaacaaattaacctggattaaccctgatcttaaccaatcagctttttgtctattgttttgtttaattgttctcattttacaggagctactgttcttccattgtctgtgaaagctctcatcctattttgtagaatgcaggctgccctgattcatgacttacaaatagaagccaattacatctataactaaatttgttctaattttgtcttttaaaaagttatcgtcataggccaggcacagtggctcacacctaaaatcccagcactttggaagatcaaggcaggcagattgcttgaacccaggagtttgagaccagcctgggcaacatggtgaaacacagcttctacaaaaaataaccagatatggtggcatgagcctgtaatcccagctactccaaagactgaggtggaagaatcacttgagcccaggaggtcaaggctgcagtgagccatgatcactacagcctgggcaacagggcaagactctgtctcaataaaacaaacaaataaacaaaaaacagttaacatcataaattttgtttttattaagaaagggcaacttaatactttcctagctcttgaggatgtaaattggttatctaacatatattaatgtctcaaatatagtatttttttttaaaatatgtttgtgtagaatatggagtgaattaagttaaaatccagataaatattttcattatcttgcaaagtttccaaaatgctatgtgtttttgcatataattatttacaacttatttttaacacattacttcagcctactaaggatccaatgacatagcctggatgtttgtctcctaaacctcatgttgaaatttgaacccctgtgttggaggtggggcctaatgggaggtgttagggtcttgggagcagatccctcatgaaaagattgttgccctccctggggagaggggatgaatgagctctctgttagttcccaagaaagctagttgttacaaagagcctagcaccccctcccccctctttcctcttttctcactatgtgatctcactacatgctggcttccctttgccttccgccatgtgtggaagcaacatgagaaattcaccagaagctgagcagatgctggtgccattcttcctgtatgggctgcagaatcatgagccaaataaacctctttttttaatacattttttagtctcaagagttttttttaatagcaacacaaatgggttaagatattcaatgcaatggttcatgccaaaaaatactttgctatcccatgtcacgttatagacttcaggagaaaggacgtttagaaggcataaagacatttacaaagcacagtagtccctgtttttattaaaacacatcattgctctatctaagtatttgctctggttctgtaagtgactgtcccagcacacctctggccttcaggtttattctattttcccagcacagcacagttttgctaatttgtaaaactccaatttctcatgaaaataatcagatttctggtttctcataaaaagaaatcatagaagacctggtcacactgggaggcatcccttatagggtaggactatgccctttcaatgagccaggctctgtcctgagagacaccattccctcccagctccatttactccttacctctccttgaaggcttttacctgctatgatctttagcaactctgctgcctttgcttgcaagagaagattaggcatataattaacatttcagtagcagatcaggcagagtcagaatgagggcttttgaaacacatcgcagcattcatttacaagtgattagtggtggccacaggactggctgtcgctgatttgccttgctttaggaagccatttttatcttccctctacttctggctgttggaatatttccatcttccagcatatggcacacttagttcctgaggtttttgctcccaggaaaagagaaagtccccaaacttaattttatcctgggaagagcgcatctaaacctttaattcagagcagatgatcactaatcctagcatagtcagacctaagcaggcaatatttagggacagacaaactttgaaataatagcaactggctattgtatctctactaaaactctgcctcaagcgtagacatggttttctcctataaatctcacccttaggaactgacaatttgccttaggtcaggatgatattagtttagcactcacaataagtttttctggaaatttagaatggtaacagaagtttatattcttaggaataaatataaactattttcttcctactatgttctgtgtgtcattgtggctggtgaataaagaagggacagacactttgggaggccgaggtgggctattattgttgtgatgaggagtgatgcctatgaaacctttaacatagtgccatatacagtaacaactcagtaatatttagttatttgtattattatgccatctccaagacacctcaccactagtctctagagtatcacaagtaaaactatgtggaatcttccactcactccagtttccactctggcaatcgtgtggtctataaaatatactgtcctctttcagacctggaagtggaaggaggctgcacacatttgaaagaaaattgtccaattaaattcattatctttatgacatagatatatggaaaatggatgtaaatgcaggagatttgtttttaaaagttgaataataaattccgctgaaatacaatgtcattcactatgtaggcaaataacatctacaaaaatttaggtagagggatgtatacatctgttaggatattctagaatgactttttaaaggttatgctgtaaaaatgccaccaggtgttagaaatagatcaaactgtgtcaaactttttttttttttctttttttttttgagatggagtctcgctctgtcgcccaggctagagtgcagtggcgcgatcttggctcactgcaagctccacctcccgggttcacgccgttctcctgcctcagcctcccgagtagctgggactacaggcgcctgccaccacacccggctgatttttttgtatttttagtagtggcagggtttcaccgtgttagccaggatggtttctatctcctgacctcgtgatccgccagcctcagcctcccaaagtgctgtgattacaggcgtcagccgctgcgcccggcctcctccatagcccttctaacagaagcaccaaatgacaactctagaagaaacatttacaactctttccatttttcatcatacctttaaattataggatgtcatttgatggtttatttcagtggtctgttgttctacttggtggtctatttcattataaaatatatcttttatgacagtaaaccactggactacagagtcatgataatttctaaattttgctgctgacctctagaatcacagtctataaatagtctgactttatatcactcctataaatgttgtcaggttagggtcaagtaaataattagaaaataattcagtatttttttaatcaagcattatgatttttatctttttgcaagtttagagtaactttttcttggacaaatgcttctcttgaccctgacactctctgaagatttgttttgtgtgccaaattgtattactgttcccaattacttgctgtcctccaagtaagaggattatacttccctgacacaatggagttgggattggtcatgtgacttgctgtagcccatagaacgtgaagagaaatgctgagagccactgctgtgaagaagcccacattctgcccataatggccagagagcacatcagccataaattaggttgttcagttcatagcctgcctccctccaagcaaacattatggtgataggcagaataatgctaggaatcttaaaggtttggtcattttcttttctcattttcagagctttgtgcacttttgacccatattgtttttaaaactttgccacttaggatagatttacagcaacccataggaaacaaaatttaaaaacaatatataaggcaattatctaagagctataatttttaaattaaaagattttaaaatactaaaaggaatggcaggaaagttctctactaatttattaaatgatacaaaagaaaatagacgagaaaaatgactaataacaaatacagcatcctctttcatattttaatattctacatattagatttaatgatgaccaggtatttgagagtatatttattgtcataagttaggcataaatgtatatatagacacattgataaattaagtgcttttgtgtgattgtataccatatctacatttagtttttgtgaactatatgtagttcacatatatatcacatgtcatgcacatatgtcatgcatgtgacatatatcatacacatacatttaggaaaaaaagttctatgaatgaaaatatatgtgtccatctcctagcttaataaattaaacattaccaatatttattagtccccaaggtaaacgctatcctaaattttatcattcctttattttttatttgtgattctttgaatatactcttttgtttttcccttttttttttttttttttttgagatggagtcttgctttgtcgcctaggctgtagtgcagtggcgcaatctcggctcactgcaagctccacctcccgagttcatgccattctcctgcctcagcctcccgagtagctgggactacaggcgcccgccaccacgtctggctaatttttttgtttttttagtagaaacggtttcaccgtgttagccaggatggtcttgatctcctgacctcgtgatccgcccatctcggcctcccaaagtgctgggattacaggcatgagccactgtgcctggcctgtttttcctctttttgaagacttcgtagacttggaacatacatattaactctgtgattttttaaaagctattattgttcaacttgagtttttgagattcaggcatgctgatacatgtaattaatgtccttaattttcactgctatatgatattccactgaatgcatctgccacattttattcatccattttttggtttttaggcatcttagttgtttatttttccttttttggctttcataaaaaaatgtttctatgaatattttagtttataacatcttttcccagtgacttttggattttcctattcacaacctatttaactgagtttactggtttgaatagagaactttgggaggcaaccaatgtgacttattttagcagacgggatggtggttgaggtgaactgatgtgcacatgaggtcaggtcagttgtgcacatgggcatagccttttctcagtgataattctgaacagcccagcacattattgctgggaagtcctttagagaccatgggtccgatttcctcttcttgaatgctgtgccaatgcattttcaaaaattactgtcatggccggacgcggtggctcacgcctgtaatcccagcactttgggaggccaaggcgggcggatcacgaggtcaggagatcaagaccatcctggctaacatggtgaaaccccgtctctactaaaaatacaaaaaattagccaggcgtggtggcaggagcctgtaattccagctattcaggaggctgaggcaagagaatggcgtgaacccgggaggcggagcttacagtgagccgagatggcgccactgcactccagcctgggagaagagagagactccgtctcaaaaaaaaaaaaaaaaaaacaaaaacctgtcatgttaatgtagtttcctatgcgaaacaagtgaattaaagagttaaaaattaatcgtgttacagatgagcttgtttaattgctgcattccgtctttttctgtagtgacttcatatgagcactgagagcagaaatggtgatgagggttgagaatttgcggttgttttcttcccaactaacttgtaaatttagaatgacctaaatttaacgacaacagctgcaaactctaatctgagtactatattataatattaactgctgaatgaaactagacatattatgtcaacgtaagagcaacattttcagggaagggtgaggaatttggactattttaaaaactaaaggaatacagcaggcaaaagcaaacaccaatctgctgacatcagataaagacaaactttatttctgaaaaaagaaacttaggggagaaaagcttagggcaaaccaccagcagatatagtttagatggccaggcgcagtggctcacgcctgtaatcccagcactttgggaggccgaggcgggcggatcacaaggtcagaagatggagaccatcctggctaacatggtgaaaccccatctctactaaaaatacaaaaattagccgggcatggtggcccgcgcctgtagtcccagctactcgggaggctgaggcaggagaatggcataaacccgggaggcggagcttgcagtgagccgagatcgtgccactgccctccagcctgggtgagagcgcaagactccatctcaaaaaaaaaaaaaaaaaaaaaaaaaaaatatatatatatagatagatagatagatagatagatagatagatagatagatatagtttggatgtttgttctttccaaatctcatgttaagatgtgattcccatgttggaggtaggccctggtgggaggtgtttgtatcatgggggtggagaccttatgaatggtttgatgccttcctcatggtaacgaataagtcctccctgcattagttcatgcaaaagctggttgtttaaaggagtctaggcggggtacagtggctcacgcctgtaatcccagcactttgagaggctgaggccggcggattgattgagcttaggagttcgagaccaccctgggcaacatggtgaaagcccgcctctactaaaatacaaaaaagtagccaggcctggtggagtgcacctgtagtcccagctacacgggaggctgaggcacaagaattgcttgagccttggaggcagaggttgcagtgagccaagatcgcaccactgcactccagctggggctacagagtgagactctgtctcaaataaataaataaataaataaataaataaataaataaatgagtctggcatctctcttgttccctctcttaccatgtcatacaccagctcccactttgccttctgcaatgattgtaagcttcctgtggcctcagcaaaagctgatactgtcattacactttttgtacagcctgcagaactgtgaaccaaataaacctcttttctttataaattatccagcctcacatatttctttatagcaacacaaaatcgactaacacaccagcagacatggtgttcttgttctcaaagccaaggcgggcagatcacctgaggtcaggagttcaagaccagcttggccaacatggcaaaaccccatctctagtaaaaattaaaaaattagccgggtgtggtggtgtgcacctgtaatcgcagctactctggaggctgaggcaggagaattgcttgaacccagcaggtggaggttgctgtgagctgagattgcaccactgcactccagcctgggtgacagagcaagactctgtctcaaaaaaaaaaaaattattataatcacgaagtttaatttacagatatgacctctttgtgcagggacctcacagtccccgtgtctatttacagaatctccagctttgaactcactaagatagggcaacctcagtttcaggtagctggaatggaaacccccatatcacagttctgacttcattgactttatatctaatcccaggtataccttgcatagaatctgttacaaggtgaggtaagtgaggtactccccttaggaacacaattaaatgggtaagcacaaaacttagcaatcaaaataaataatgttttaatacgttatttaaaaatattaaaattaatgcaaaaaagtcaccatgagcaaatattaaaatttagacagcaggatctgagcctgcacttttgcaactcaccttgttcatctcaccttaattcctgttaatttccttctcaattatttccagcaggacaaaaattcgttggacttggtatgaagattcaatccataccttgcagaaatatttggtctaagaaggatatttcatctaggacgaggtcatttattaagtttaattctcccatcatgtcttcaaggcaacaaatatagtctaagaccctctatgaccagttttatttgccactttccaattattttgtcactacacagccaatcacaatctgttgtaagattttactacaaatgatgacttaatcttgctatcatgattaggatgattatatagttttcttcattcaaattgggacattctttatttgaaaggagtgctatagaaatcatgccaggactaatgggactgacttggacaaagcagtattgctttcagtatgcgctattatattttaaccacgttcttgtctcatggatgactttattagcataagagtggccacttttaaaaagcagcatttctgggaggctgagggaggagaatggtgtaaacccgggaggcagagcttgcagtgagccgagatcgcaccactgcactccggcctgggcgacagagagagactctgtctcaaaaataaataaataaataaataaaaaataaaaataaaaataagaaagcagcatttcctacatattgcattcaattttttacttacctatccctttgacttttaaaactttttttcttagtctgtgcttgtgtctttgtgatgtttccatcagacagcaggcggcactgcagcgcactgtgcaccgagttttgcattcctgccatccttttatacttatttatttatttagacagagtctcactcttgttgctcaagctggagtgcagtggtgcgatcttggctcactgtaacctctgcctcccgggttcaagcgattctcctgcctcagcctcccttgtagctgggactacaggcacccaccaccacgcccagctaattttgtatttttagtagagacggggtttcaccacgttggtcaggctggtctcgaacttctgaccttaggtgatccacctgcctcagcctcccaaagtgctagggttacaggtgtgagccaccaccccggccttacgccattccttgaaatttgcgtttatggcatctttgacttacttaataacacatcttgtaccatcgtgctagaaatgctaacttgtgttcagaatttctgcatccttcttaagtgaaactttgccaattaagtaaacctatgataatacggtaatgaaatcttatcccagtatctcatttctagtgccataatagtgacaatttatcttgtcctcttcagaggggcttaacctcactgattctgtcagtagtaatggatatatttaattaattcagcaggaagttctgtctttaagctcattctctttcccctatggggagagtgaggacaagcttctgcaaaagagccgattagcagaacttttgatattctgaagacagttactgtccctctcttgctctttctcttgctctgtgtgtgtgtgtgtatgtgtgacacacacacacatttaatatgtttatataaatattaacatatatatttaatattttccagtccttatctcaatgctcttgattgataatgaggggcagtgaaaatcattacagagatatacaaagtttacattaactgtatctagatgtagagttttttaaatcatttgaactctgagtttcaacatttttttaaagcaataaatgaaagccttcagagtgcaaaaatttttaatatgatattaatttgaaaacctcaaagtctctgcagtgattttaaatatgatgcagccttctactctaaaaatatgaaatctagattattaaagtattactagaatatggatttagttgttaatttaaaaatctaaataaaatacaacagtttttatgacagttctgaggggaaaaaaacactgtggattgtgtaggagttaaaggctgaatcttcatttcctgctctctgaaactgtaccagtgattgacaaccacaaaatagagaaagattaatgcagaatatgtcagtgtagcagataaattccacacttcataaaacattttttcacagagattaaaaaaatagaacattatcaagagaacgcaacccctgggtaataaatgttaatatttacatcaatatataatatactataaatattaatatttaaatgacactggagataacctaaggaaaaactatcagtttgactgggccacagggtggctcagatatttggtcaaacattattctgtgtgtctgtgagggtgttttctgaatgagattaacatttgaatctctagctgagtgaagcccactgcactccccaatatggatggtcctcatcctcttggtgggaggcctgaatagaacgaaacagctgaccctcccgtgagtactggggagctccttttgcctgactgtgtgaactgggacattggtcttttcctaccttcttaaatgaacgaaaacattggctcttcttgagcctcaaggctgcaagcttttggactataccttacctctgctgggtctccaacttgctgacttcaaatttccatactaatcagcttctgtcattacttgagccaattctcaattctttagacagtccccaacttacaatggttcaaaatgattttgcagctaatgatggtgtgggctgttttgtttttatttaataaattgacaattactttagctaaaataataaagattgcattttgttttttactttcaacatagtatttaataagttacattaaatattcaacacttcattataaaataggctttgtgttacatgatttggcccaaacataggctaaatgtatgctaatgtaagtgttctgagcacatttaaggtaggctaagctaagctatgaggtccagtaggttaggtgtattaaatgcattttcaacttgtcagagacaagtgaaccagagcaactccatcttaaataggagctgggtaaaatgaggctgaaatctcctgggctgcattcccagatggttaaggcattctaagtcatagaatgagataggaggtcagcacaaaatacagatcataaagaccttgctgataaaacagtttgcagtaaagcaaccagccaaaacccacccaaaccaaaattgcgatgagagtgactctggtcgtcctcactgctactctcccaccagcaccatgacagtttacagatgccatggcaacgtcagaaagttaccctatatggtctaaaaggggagggatgaataatccaccccttgtttggcaaatctcaagaaataaccataaaaatgggcaaccggccgggtgtggtggctcacgcctgtaatcccagcactttcagaggccgaggcgggtggatcacaaggtcggcagtttgagaccagcctgaccaatatggtgaaaccctgtctctactaaaaatacaaaaattagccaggcctggtggtgcacgcctgtgatcccagctgctcaggaggctgaggcaggagaatcacttgagccctggaaggggaggttgcagtgagcctagatagtgccactgcacttcaggctgggcaacagagcaagactccatctcaaaaaaaaaaaaaacaaaaccgcaatcagcagcccttggggctgctctttctatggaataaccattcttttattcctttactttcttaataaacttactttcattttgcactgtgaactcaccctgaattctttcttgcacaagatccaggaaccctctcttggggtctggatctggacctctttcctgtaacaaacttatgatgggtttattgtgacataaccccattgtaagttgaggaacatctgtgtgtgtgtgtgtgtgtgtgtgtgtgtgtgtctatgtgtagacagagatagaaagagatagagagagacagtactctagagaaaccttactaataatatatgtagaacaaacaaacaaaacaaaaccatttctatattatgtcacacctaacttgttgctttccgctctggtattattgttgaataaatgagcaaatgccacacagttacaaaatgatactttttccatttttatagccaattcaaacagaaaagcaatcttatggatactatggtccacatcataaaagcatattttatttttgtattttatagagtagatactgtcaataaacattaatctaaaaattaatttttagattaatggcggccatactagttatagtttatgaatcatgtttggtcaactagtagcaggatataatttctacttggccaagcccagtggctcacagctgtaatccttgcacatcgggagctcaaggggagaggatcacttgagcccaggagttcaaaaccaacctggacaacatttctacaaaaaaatgtaaaaatttgccaggcacagtggcacgcctgtggtcccaattactagggtggctgaggtgggaggatcatctgaacctgggaggtggaggccgcagtgaggtctgatcacaccactacactccagcctcggcaacaaagtgagacctcacctctcaaaaaacaaatcatgtatatggacttagttcctttaacgtgaaataatgccccatatgtgtacactccactgatttgtaggaaaaaattgatgcaaggatgagggatgcataaaggaagaatttctccagtatctctcaatctttttttctttttctttttctttttttttttttttttgagactgagtctcgctctgttgcccagtctggggtgcagtggcacgatctgggttcactgcaacctccgcctccggggctcaagcaattcttcctgcttcagcctctagagtagctgggattacaggagcctgccaccacacccagctaaatttgtttgtattttctagtagagactgggtttcaccatgttggccaggctggtcttgaattcctgacctcaggtgatccgcctgcctaggcctcccaaagtgctgggattacaggtgtgagacactgtgcccggtccagtatctctcaatcttgatttaggggttagagacttcttggccccgactttgtgaccactttcactagttatctccatgcccgctctggagaagtgaagctagggaggccttcagctgctggctcactaggaagcactcacagcgggagggagccgactctgccctccaggtggttttaggtccacatctgtggagggccaggagctggtaactattctgtgatgcacgttgaattttctccactgtaactcattccttggacatcttgtcagttcactcacaaatgatatgttgacagtatttgtgttagaacagcgtgtcctaaagtgacattttacatgtagctgctttgtgcatttatcttttataatacaaaactattatccttaaaaaaaagtcatttaagtacaaacttaaaaaagactttcggaagtagttaccaatttagggatacacctgggatacgatattattctttttaatcaaaacttcagccccatggaaaatgtagcagtagacactttagatgacagtgacacaaatcatatccttttatgtttgggtaggctttaacttctaaaatcatctcttacctcattctcctacttttaaggaaaaaagtttcattttaccttggcatgtcatgactgctgacatgatttccaacatgccattaaatagaatcatcttgaagaaggaaggaggggaaggaagtggaggaagaaaacccagattatcacaggctctggtaaacatttgataggaatcactatctcccttggtcctcaaaaaactccacaaaccagatattgtgcatctggcaaaagcagaaatacaaagcagaaaggtcaagcaacttgcctctgatttcactattaaggagagcagagcacagcctcaggttcaggccctggttctagagcccctgttctaaccactgcttgcggctgcccaccctgcagaacatgctggcatactatgcagaggcaaaggcaatattttactgaaatgtcagaggtttatgttattggcatactacagatgaccttccttgtggccccaattttgcttcaaataatagaaaatgcacagtaggctggggatggtggctcacacctgtagtaccagcactttgagaggctgaggtgggaggatcacttgaggccaggaatttgagactagcctgggcaacacagagagactgtctctaccaaacaaagaaagtgcacaatagttccacatacacattttacatctgacagaaactaagaaacaaaaatctggaatacctccacctaagactgtacagcccctggttacacagatgtgactgaatatttctgtggtactctcaggttgctggttctcatttccattctgatttctgcatctttccactttcatgaattgtattttacactatgtaagttgcaaccatttggaaaaacaaacaaaaataagtatttttgcagctaattaatttataaagtttttatttttaattcacctcatttcaatggggaaataagtataagatacaaaatagagtcatgaataaaataaaataaaacgtgtataattggtatttctacatgaacataaatgcatgaatatgttgttcaattgcttggtccgagtaatacttttatttctgagagtacttgctgtcaaagaaaggttgaaacatgatcaattacaagacactcaaggttaataatagaatttagaaaaagcaatggacagggatgctgcatggtaaagttgtagagatcagatatcagccccaattttctttttttttatacagtggtgatgatgatgttgatgttaataatcatcttaacatttactgagtattaatattacgtctgcactgttgtagcactttgcatgtattaactcatcgcctcttcacagaagccctaggaggtaatatatcagtaatatttgcattttacagaggcaggaagacagaactgccaaggtcacaaggtatattagtttgctagagacatcataacaaagtgccacacactgggtgacttaaacaatgggcattttttgtctgacagttctggaggatagaagtctaacactaaggtgccagcagggttggctccttctgaaggctatgaacaaagcatctattccaggcctctttcctggttttgtagacacctgtcttcttctttgatctcttcacatcatcttccctctacgtgtgtctgtctccaaatttccctttttacaaggatattagtcaaattggattagggtcccttcacaacaacctcattttaactcccatgtaaagaccctatgtccaaataattcctgggttctgcagtactcagtgtttaaaaattcaacatatgggctgggcatggtggctcacacctgtaatcctagcactttgggaggctgaggcaggcggatcacctgaggtcaggagtttgagacaagcctgaccaacatggcaaaaacccatctctactaaaggtacaaaaattagctgggcatggtggcaggcacctgtaatcccagctactcaggaggctgaggcaggagaatcacttcaacccagcagctggaagttgcagtgagctgagatagggccattgcactccagtctgggtgacagagtgagactctgcctcaaaaaaactaaataaataaaaataaaataaaaattcaacatttgaattctgagagatgcatggttcaacctctaacacacggccaggagatctgcacacaggcagcctggccctgcacccagcctcagggctattcagagtgtggtctgtgacccgcaacctcaagtgccaccctgggtttcccttagttccttgaacacctttttttcagtaagtctttaggaaggtaacataatgtaggtaattcattcaaagtaagaatgtagctccattaatgacatgagtgcattctgtcctggttttgttggattattttattcttcccccttatttgtcctccctggatgttaagtcagtcctgttgggtgatgtaaaaagggcgagtgtgatctcagggctcttagagagagggtcaacaccgtgacagcatcagtcaggcagtttctcacaggagccatcggcttcctgcggcttcctccggagccttccttcctgctgctccacaggggctgctgcatgggagacgctgccctgctgagctgtcatttaaacttattctgaagattaacaaggcccatcacttgcagatactaagcccctatcatgaacacagtaaaatatttacttgaacaaattaaaatattctattcaatgatgattcagaataaattaaaatactgtagaagtgtgttttatgtaaatattttctcttttgttctggattttaattatcttgaatttttatttgcagaacatttaaggaagtttctattttaaaccagccttggagggttttcatgacaaggaattgcacattggatgatcatttctaccttttgcaataactacttcttatttgcaagttgtgtttaagtgaacaaagacagtaagtattaaataattgaaaactattttttagcagatttgttggataacaactatttaaggaggttaaacaaatgcccttcagattttcagtcaatattggctattactaagctgacttgcttctttaatcacagggcttcatttgaagtccagtaactatgactttgagaagatccttggtttccacagcatgtatgattcatacccacaggtttccctgtgaaaccttttccaatcttttacactatgcttcagaatcctgtacctcctacttaaaataaagaacacttaactagtaaaaatatgatactgcaagatgagtgtcactagatgatagcatcatgcttccactgtaaccctgtcttcatatttaaatgcggatacactgtttacttcttcataacataaagagataccaaatacttattcaatacctaacaatatgcagcatttatatgaactttgggtaatctttctcaagtgggtcctagaacatacatacacacacacacacacacacacactgaaagtatcgatataaaatataggtacaaaaatgtttcagcagagattacagaagaatgttgaaactgcataaggcatgttcagaaatttcagagccagttgagcagcaaaaaacacagaaatcctgtcaggagatactatttccaaaatcctcagaacaaaacagtcaaactacagcgagaaaccttagagtgtgttcttgggcaaaatctaagaatttagccaaggtcaaaacccgaagtgtcagagttcaccagttctgtcatcataatttttccaggactcattttcctcatctgtatgatgagggggttagcctggataaaatacagggcctaaccaatgccctgtctctgtaagggcagcaatattgtggaagaatttctgcactttaaatatccgtcttggcagcaaatcctcagagtcatgaagtagcacgtcgtttatcctcgtgtatctgggcacagatgctagtgttacatccatccctcactactcatcaacatgagtccaagacatcgatcagttctttatttagagataaaatgacaggatagatcctctctgtgtgtttatttcacaattccttcatgacttgcattcccctttctcatcagaatcagtgccctccatttcttcttaaaggatggtattttgacataaatggaaatgatttttgccttctgtgagacagggggttttttctccactttcttataggtcaatttccaaatcatgaatgacggactcactaattatagtactgtcaatgttttcttgacagggtctttatttttttcctccaggagacttgggaatgagtacattcctatctaatgtgaaaatccaaggttattttccttttacataagatcactttttcccttagaaatcacatagatggattatagaagacattttataggaaattataaaatctaggaaaaagttgcaatattgcaaaattgctgtaatatggcaaatgaactgaaacatggggtttcatatgacatctagtaaattttattatttatactgtgaaatcccattaaatgatgaaattaaaatagtttaacctgctaaattgtgtgttcttttgaccgctcttgacagggtggacaaagggtcaattaagaatcaccctttttgatgccagacaagctccagtgagtcagagcaaacacgttctgaagtgtcttactcaaccacatcacagaaactgtctcaacattttgccattcttaaaattagtctcccaagtctattcatgattcaaaggtggtgaacatcagctatatacttttctgttttgcaggttacttataattccttaagctgtttcttccctccatctctaacattctttcattctttgaagataagctatggacaattagggaaacataacataattgtctgtgcccttgcttgggtgtttcaaatattagtattgtaaaaatctgtgacttagagggattattctcacacacacacacacacacacctattatccacagattaacttattctactcttaagaaaacattttatagatgtattctcaatacttccctttacggaggatgttttttctattattaaattttaaccatacataactggaaatcaattatactgaccacctgcccatatgagctattcaggcatcattttttttcccaacacgctatgagctgtgatgagaatgagaaaaatagcacttgataagtcaactccacaacccaactcagtattctacaaggttctctttatatttgattcatttgagagaaaaaaccctgagggtgaatatagagtaggtaatgttcaaggaaaaaaaaagcctattttagatattttccgtgtaattctcagaatatgattaaaggaaagatcttttgaattcagatttccatggaaacactcacagcatttttcaatggcgagtaagtgagctacatgatctaacaaaccattttcttactgaatttaaaattgtgttagttagacattatcagtttccctccctgttcaccatgagcctgagttgtttccctaggcttggtaacatcctctcccctttccttgtccctgggttgctgttgtaaagtatgccatccctgtggttgttaattctaatgcaaatttattagtcaggccattctcagctccctatgatgggcgtagaaatggggaaggtacccttggtaggtaacttatctcattttgatttctaaatgatgtaaatgtaatagcttaaaaaaaaatctccatataactgttctctgcaccctctgattgggtaaatactcatgcaaattgaccatcttatcaaatatatttttatgaaagttaaagaacctgcaccacatacgtagcaagacaacttccagtcacttcttaccctctgagccttgggcttctctgcagctgggcaatgctgcacaaacagcataaatgctccagttgggcatttggtcttagaggggtaaaagatctaagaatgcttttgcctgttacacgattgggcaggttgtatttcatttttaaatacaaaagaagtaaataatcgatgtgccagaaatatatttgaatttttgtcagttgacatttcagtagccattatggacccaaagtcattttgtttaaggagctgatactggataatatatttttatttaacaaaagttatgataacatgtagtccacatgatctgaacatgcgtgtcctaaaaatatatttgaaaatgagagaaatgcatatagagatgaggaaaaccctagctgaaaagataaatatatagacgataattttttttaatttggggagaagatgatgaacatgaaaagaattatgagtttgaaaatctgtctacagaaacatcaggtaattccttatcagtgcacttacaacacatttcctcatatgcatgcctgacagctgccacagcaaagctgccattcgagaatttcttttaaaagttaatgtacacagatatccatgagagacttagtatttccagaagctttcgattggggtagagttgaaagggagggtaatattttgcagtgctgtggaataaagcagcatctgtctcaattacatccagctcttatatgcagaagatttcccaaagatggcagttttgataaatattgacctccaaagctctatcattttgtcgacctaaaaggaagaggctgagacacaaactctgtaatttaaagagtttactgagccaaagtgaagacagttgtcaggaggactcggacccgtgtaaccttggatatgagtttggcctttgttacaaacagatttttaaaggcaaaaaagagggagaaggcatggctgatacaaagttgtttgtcaggcattcttattgatttatagaaataacattgattagtgattggctatacattgttaagctacagggtgtgggttatagcgtttgctctggcattattaggttaatttatagctacttgtggcaataagcagtttcaggagatgaatacctagctcaaagcggggagtaggacttgactgctgcctcattttaatgtctctctgggcctcattatttaaaaggactcacattcctcagataaaagttcttttctcgccttttttttttttgagtaatacagaatcaatcaagcaatattgtctccattgcacgaagtaatgtgttatttacaccatggatattctaaaatgaaaccatgaatgtgagttgttaaaaaagcaagtacaataaaaaatgcatgtccaaaaatggatactcccaggctgaggagctgagctgtcagcaacgggaatgatgactcttggcctgcgaaagtcactgaaaattgaatttgagggcacagaggaggatgggagtcagtggctaaaattgttgagaaagtcatttacatttttcttatttattatttctattcttcagagtctaatattttcactaattttaaaaaaactttttcttggctgggcgcggtggctcacgccttaatcccagcactttgggaggccgaggcgggcggatcacgaggtcaggaaatcgagaccatcctggctaacacggtgaaaccccgtctctactgaaaatacaaaaaaattagccgtgcgtggtggcgggcgcctgtagtcccagctactccggaggctgaggcaggagaatggcgtgaacccgggaggcggagcttgcagtgagcagagatcgcgccactgcactccagcctcggtgacagagcaagactccgtctcatttaaaaaaaaaaaacaaactttttcttatagtcccctaaatgtttaacaatatttaaactatcttcaatggttctaaacacatttggtacctttaaaattttatttcctattttataagaaagatgagagatttggatgtaaacacacagttttgcatttaggtgtaatgatgtcttggctcttcaatctgaagagaaaatataatgactagtaattaagttggaagtggtatttgaaaaccatctattaattgttttacctactttctactacctagttttaagtttcaacataatttttaaaaaaatgtttaatactggccgggtgcgatggctcacacctgcaacctcagtactttgggaggccaagatgagtggatcacttgaggtcaggagttgtattcaccaacatggtgaaaccccatctctactaaaaaaaaaaaaaaaaaaaattagccaggcatggtggcacacgcctgtaatcccagctacttcggaggctgaggcaggagaatcgcttgaacccgggaggcagaggttgcagtgagccgagatcgtaccattgcactccagcctgggcaacaagagcaaaactcagtctcaaacaaaacaaaacagaaagtttaatactgatgccttcttgcatatctcactattcctagaattgcattttatttgttgttgttgttttcctttccctgctgggctggggtgggtggtgatatatgcagtgatgtttacaagcagagaggctgttgcagcagaggtctcatctaacagggagccttaatgagcagtggcgcttataaattagggagatactgaagcacgctccagattcagtcaggacctcaggatgagagcttggggttggggaagaaaacataaaagtggctgagtatttttgaggggttgatgagtctaagcccacttcttaagctttgctctttgatttcctgtgtactaggtaggtatttaccttctcctcctcctttttaagctggggtgcctgcgagcctccatgcagcattcgctggacagtgctgaggagtcagttatcagtgccgctggtggacgtgaacgttgctctgagaagctgtgtggccaagggtgacatttcctccaggcaggaaagtccatgagtgttgtttctttgtctttgaatgaacagtcaagccatgcctccagacatctttgacataagcacaggcctccacaagacttttaaaatactctaggggagaaaagtcctatcttttcttcacccgccacaaggtttacagcccaaaacccccataacaaaagacaggttaacaagagaaaagcataacaaaggtatttaatcaaagttttgcttgacacaggaggcttcagaaatgaagacccaaacacccagggggaaactgtatttttatgttaaatctgatgaaagaagtgaatagttgtggagcaacgtaactggacaaaagggatatgatctaatggtaataaactgagcagagcccagcaaggcctgtttgttctgattcttcttggtctctctgtgtgtaaccgcccaatgggttcatctagccccctgcctagacggagctgatttatcaagacaggggaattgcaacagagaaagtgtaatacacacagaaccagctgtgtgggagactgaagttttattgttgttcaaattagtctcctggagcatttggggatcagagtttttaaggataatttgtgaactggtggggggcagtgagttgggtgtgctgattggtcaggtcatagggagtcaaagctgtcctcttgtgctgagtcagttcctgagtggggccacaatatcagatgagccagtttatcgatcggggtgatggctgctgatccatcaagtgcagcgtctgcaaaatatctcaagagctggtcttaggctttacagtagtgatgttatcccctggagcaatctggaaagaacctcgtagcctccagctgcatgactcctaaaccataatttctaatcttgtgactagtttgttagtcctacaaagccagtctagtccctaagcaagaaagggatttgttttgggaaagagctgtcattatgttcattttaatctataaattataaactaagttccttccaaagttagttcagcctacgccaaggaatgacgaaggacagcttggaagttagaagcaagatggagttggttaggtcagatctctttcactgcctcagttataattttgcaatgacggtttcatgtgtagcattcctttctccaggtaaggggcaggactcctctggaatgagggtcttatgagctctcaggggaggtaggtaaaagataacctttctagattttatggcttgtttcaggagacagaaggatgggagaaggccaaagagaactacttgcttctaaaaccctcctgtctcctttagtgcaacaatccacacatgccaaggcaccatactttggggtactgtgctctgagctccgataatacaaagaagtagaaccatgtcacgctaaatgtttaatatgcagctgggggttttatctaataaatgcaataacaaatcatatctcctcatgacattagggttttagataggcactccatggtctcaaacagattttagcttcaatctctacatagctgctacttatttctatgaaaacaatctttgaaaattgttttcaagaaattacagggctgggcgtggtggcttatgcctgtaatcccagcattttgggaggccaaggcaggaggatcaccagaggttaggagttcaagatcagcctggccaacatggtgacatcccgtctctactaaaaacacaaaattagccaggtggggtggaatgcacctgtagtactagctacttgggagactgagacaggagaatcgcttgaattcaggtggcagaggctgcagtgagccaagatcaggccaccgcactccagcctgggtgacaaagcaagactctgtgtaaaaaaaaagaaagaaagaaagagaaaacaaaaacaaaagaaattatgtaactggtctgctcaagataattaattttgtgtaattactgaacatattaaaggctctttattttattttatctttttgtgagacagagtctcgctctgtcccccaggctggagtgcagtggcgccatctcggttcactgtaagctccgcctcccgagttcacaccattctcctgcctcagcctcccgtgaactgggactacatgagcccacgaccacgcccggctaatttttttgtatttttagcagagacagggtttcaccgtgttagccaggatggtcttgatctcctgacctcgtgatccgcccgcctcagcctcccaaagtgctgggattacaggcatgagccaccgtgtccagccgtaaatattttttaattaaaaaaaaaaaaaagctggttagtattcttaaagaaatgttctgttgcagggtttggattgttattttcttaaagctgtttcttttggccgggtgcagtggctcacacctgtaatcccagcactttgggaggccgaggcgggcagatcacaaggtcaggagatcgagaccatcctggcgaacacggtgaaaccccgtctctactaaaaatacaaaaagctagccgggcgtggtggcgggtgcctgtagtcccagctactcgggaggctgaggcaggagaatggcgtgaacccaggaggcggagcttgcagtgagccgagatcacgccactgcactccagcctgggcaacagagcaagactctgtcccccccgccccccaaaaaaaaaaaaacccacacacaccaaaaaactgtttttacgtcattatctgagcggaagcggaaccgcattagagggtgagtagttgggctaaataggactcgcctttctcatattcttttttcagatgataccctgttgagctggtaggtaggaagaaccagcgaagcgcacagttaccggagaggttatttgcccaatgttgagaaacatatgtgtgtattagaaaaaatcacatcgactcccaggaatcctgcaacatactgcaactgtgatgctgaccagaatgagtggagatttcctcatgatttctctgtgtgagatgcaggttaaaaaaattattacttaatatatgaataggcagatattgaataagctattgcaatgaaaaaataaaagtatgccctagtgagtaaaaaatgtaagctgatgaaatataatacaattaatatgaaaactaaatatcaagatggaaggtttgctagttcactgtggataatagatcatgtacatttttctagtaaatagaaatacttggcttccattcactagaagtccaacatcatctctttaaatttaagttcgattaagcaatctattactaccaatatttaaagtagtaattcacaaagtgtatctgcttataaaagtcccatgattatctacatttaagagttaatgctgcatatcacaccccttggggacaccatacattaacatatttagttctgataggactgtttacttgtctcaatcctgattttccaaagtcagttaatcacaaaattatgtaggcaatgtcatatgatcaggaaaaaaagtgttccgtgaaccccaccctgcaaagggtgatctaaaaaatgtcagagattcgaaaatgtttcaactgtctttagaacaaagcaataatctcctgtggattgcaatacttcctttactgagaatttggaaagttttttgtagatttttaggttatagttggaaagtatgctgattttttttaacatggaaagtaaaagtggtttttaaatctctggattaatttattaacatgtatcactaactcaaaaaaaaaaaccttttttttttttttttgaggtggagtatcactctgttgcccaggctgcagtgcagtggcacaatctcagctgactgcagtctccacttcccgtgttcaagtgattctcatgcctcagcctcccaaatagctgggatgacaggtgtgcaccaccatgcctggctaattttgtatttttagtaaagatgttttgccacgttggccaagctagtctcgaacttctcacctcaagtggtctgcctgcttgggcctcccaaactgctgggattataggcttgagccacagcaccggccctcaaaaaaggtttcataaagccctagtgcttcatctactagcctatgtatctccaaatccatttgaccatgcagcatacatttatttttaaactcttaaaggtcaatctgggtgtatatatcattgatttggctacagaatgtcagttatattttatgtctttggttaaaaagtgaggatacaaaattttattctcaaaacacgtttatgtaatgttgattaataaaaataattcacctactcatgtttgataattaaataattagttttatctttcccatcacagtaggtgacacatagaatatttaggttttgattttgtcaagatgaaaatgaatagcaaacctgtttggaattctgaattcaatctcaataaggaatagaaaaaaaaaaaagcagacttcattttaatttggtttgtattattcccacaggaatatacctggggcagataaatcttctagaaaatcagatgtcctttcatatgagaatagagttcaatgatatacttttcatcatacacatcatatgacaatgtcatctttaaatatagtaaagggggccaggtgaggtggctcatgtctgtaatcccagcactttgggaggccgaagcaggtggatcacctgaggtcaagagtttgataccagcctggccaacatgacaaaaccccatctctactaaaaatacaaaattagttggcatggttgcatgtgcctgtaatctcagctacttggaggctgaggcaggagaattgcttgaacctgggaggtggagtttgcagtgagccaagatcgcaccactgcactctagcctgggtgaccgagcaagattcattttcaaaataaataaataaataaatgagaaaaaaatatagatatagtaaagggaacaattacattctacaatattttagcagaagtaaatatggtttaattcaatggaaacagctctgctctatagaaaattcacaaatattaaaaataaacacactctacattaaacctctgagcactagaagcttacctacttattcataggctcacatactgtaagggggtaaatcccaaaacccagataagtcaaatgaaaacttcactatgccctccctttatctattatattatgtgcagttttgtgagttttcaacataaatgattagcttctgaggagttttaaaagcatttgccatagatcaacgatagtatgttctaaaaatgagtcatcagttaaagctacagtaacatgaatatagtattaatagttacagtcaatgaaaaaatgatgactttatttttgtctttaagggtataaaaagcgtattcaaagttactgagggtactcagagttaatttttcacatcaaagggaaagggctaaggaaggaattgttttagcctttcattcaacattgtaactgcaaacaaaaaattactttgaaataaacatacagctgtaccccttgctaattaagaaagaacttcttggtcataattatataatggccaatttttacttctaattccggcttggatttccctagtttatttattagccattgagttattatgatcatccagttgttagcctttagacataatatttgtattcgctgttgattaatttttttttccaaaatttacataactctggctgtcctatcaatttcccatagagttatcattccacttgaatctgtgaaaagtgtctgattaaaaatcatacggataattaccatcaacactcaattctcagcagctgttgaggaggagcttcagttagatacacatcatcccaaagagaactcatcgtgatggaagggacattagaaataagaggagagtggttaaatcagtaaaagattgactccattacactgccatctgttcatccacgaccttgcttccattattctgtgcccatttattgatttaatgacatgaatattgtttgacaactgcccagtgtctgcaataaatgttaatttttttgctcaacggttgttgcattgaccatgaaaatgtatttgatcatcaatcattttcactgtacatctggttagaaaatattggacactatatgaaggcctttataaggcaaatacagataacttgtatttttagtaaattctaccaatgaagctgtgccgatgacatacttcccatgacatgtctgagaacacagttccccgtaggagaggtgagctaccaaagtgtaagcatcagtaagaacagcactccaagttatcgcaagcacctattttttttttttgagtcagagtctcgctctgtcccccaggctggagtgcagtggcgcaatctcggttcactgcaagctccgtctcctgggttcacgccattctcctgcctcagcctcccgagtagctgggactacaggcgcccgacaccacgcccggcaaattttttgtatttttagtagagacggggtttcaccgtgttagccaggatggtctccatctcctgaccttgtgatccgccggcctcggcctcccaaagtgctgggattacaggcgtgagccactgcgcctagcccgaaagcgcctattttgaaaggatgtgctacctaaatatttgtagctaacatcacattgttagaaatgatgcactgaacagcagttattattttaccaaaaaaagtttctatggaggaatctcttaacaagcttatgacaggagaaaaaaaaagaaaactagacaaggttttaaattatttctacagatcaggtaacacaaaggagtctttagttcctcaattttcttaagcaccaccttgagtgctgaataattatatagcaagtctgaagatctcgtataacatgctacatgagcgtttaatgcgaatcacatagtcttatctcctgtattaggtcccatgacatcttgcttgagtatctcagtatttaatttattgttccaaccacataattccctagtatatttaaacatgctcaggtctctcccaacttacacacccacttgcatgataccacactaccctagagctaaccctattgctctatttccattcattaattcatccacttattcatcaaatatttaatgtgcatcaactgtctgtcagcaatgtcaaagttctgttgatatagtgtacaagacaaagcacatctttactctgccatttcgatcttatattttcatggtggaagatgaaaataaagtagataaataaaaaatacccaaacatacacagaaataatataattgcagaaagtgatcattgctattacaaaaataaaacacggtaatgggaagaattagaatggctcctcaaggttctctccatccctactgccgccatcctagaacaagatggcatcactgtgcttcttaaccagatggccagtgacatctgagtagttccttcacattgcctgactctcctgattattttccaacactgtagaaacttttaaaaaaggaatcctcagccaggcacggtgactcacacctgtaatcccagcattttgggtgggggagtggggcagatcacttgaggtcaggagtttgagaccagcctggccaacatggtgaaaccccatctctactaaaaatacaaaaattagctggacatggtagctggcgcctgtaatcccagctactcgggaggctgaagcacaaaaatcgcttgaacccgggaggtggaggttgcagtgagccgagatcatgccactgcactccagcctgggtgatagagcaagactcagtctcaaaaaaaaaaaaaaaaaaatctcacacatactagaagtagaaatttttagccagaggtgacaatgaaactttggcttacctgagagatttcacttttcaagagagtattagacttgcacagggcatgttattggctatataattcacttttatccagctttcaagggaaaagaaggaaaccccacctaacataatcataatataaacattattatatatgcttttattactattataattatatattacattatttaaatcataaacattatgtcaatttttgcttttcatatggacagtagtaataatggataaatcaaatgcatattgcatcattagaagagtgctggccttgtatgaacaaagttttagttataagtcatcatactgtttctgagtcataaaagaacgacaactgtcttcctggttctatcgcattgcttatcccaggttccataacattagtaaaagtcttattatccaatcactgagcttcacatgccctgcaggtatgggcgctacatcttatacaataattcaattttgttgttggataattcaggacctctcccttgtcaaagctaatttctaaagctaaagattcacacactgtgggatatactgtggacattccaaacacattacggttaaagcatatgtcttggtgtcagacactgataaagctttcttggattcaatataaaacttatgggaaaaaaaactagtgtgtcaatataaattataatttatatcaagattgagaaatggactccttcaaggttccactattagtgatgtatatataaaggattaaaatactccctcatgtgagtaatggtgctacagacacgttcccattggcatctgttcacagtcaatcagtaaattaagagctctgaaaccaaattttacttattatgactaaatcctttacttttcctaataaaaatatattgttttcttttaaaaagaatcttaatgaaagtattgtaggtttattggttgatttccatcattatcaattgaatttcattatttatttatttatttattattctttttggagacagtcttgctctgtcactcagactggagtgcagtggtgtgatctcagctcactgcaacctctgcctcccgggttcaagcgattttcccacctcagcctctcgactagctgggattacaggtgggtgccaccacgcccagctaatttttgtatttttagtacagatacagtttcaccatgttggccaggctggtctcgaactcctgacctctagagtcaggcctcctaaaatgctgggattacaggcatgagccaccatgcctggctcattataatttttaaagcattagtttcattcattaaatataagttggcttgggtcaaatggaggctgaaatggccattgttcagggtttggctttgttggctctagacagacataatgaaagtccctggagaagtaaaagctttttgtgagttctgtggtacttccatcagcagcatattgttaccactgaagtgagatcaagtaatatcagttctaaagtgtatgctgggaacttttatcagagacatttctgtgcaattgtagaagtgaaaatagagcaggatggactgaaagacaaatgggaagtaaataaggagaggagaagctaaaatattgaaatcagtaaagtagggtgaagggggtttatttgatgggagatgtgtgagtcttaagtttaaacactaatgggaaatggccaatagaaagagaaaagctgatggaatcaaagaatttataggcggttggagcatcaatcattttcattgtacatctgagtactgtacattcagagaacaaggaaacattttattttccaactggattaaaaaggaaggtgattaagaatggctggtatgcaggcatgaattcaggagcagggtgtgtctcaatctggaggtaattgtcttggaggagctttgaaagtgaaatgcctttgtagaatatgcaattgtaaaataagacttacctttgcaaaccaactacattatttccagatccatgccttaaaatgttggggggtgggggtcaaagcaaagctctctgaagatgtctctggatgttcccatcaggagtgaactctgtaaatgaaacaatttcagaaaatagaggtcattcagtctttggccattgctgtacaattgtgaatgagtaacattacttcattattaagtcaataatgctatcatgaggacagaaatggaatttcaaaacagatcagtctatgagtttgctttgtttcatttcttcctttattaaatttttcttcttacaaacatgattatattttcttaaagttcatctgctgctgcagtttctatttgaagagcataatcagtttcccagcaaccaaaaatagaaatggtgctgtctcaagaatgaggacttaaaggctaataatagattccagtgattgtgacttagaagctctgattaaagcataattttctctgcctcataagaacaggagcccaacataactgtattagaatatgttcagcaactttatttttgcaaagggtttgccaacacttggatttctcaaagtagctttacaaggtgacacttcattcattactacccatagttaactattttaaaattcagacttagtggaatttgcccaagaacatacaatatagcatgcttagaattgaaacttgcctgccattctttcctttgttttaaggcagtgtttttcaaacctaatgatcattaaaattgcctgagaatgttgttaaatgcagattctagcaagatcccaggtgatgacaatacttcaaatagcaagtttctaagacattttgggttgcagttacaactatacttgcaaacagaaccgcctcctgggttcaagcgattcccctgcctcagcctgccaagtacctgggattacaggcacctgccaccacgcctggctaatttttgtatttttagtaccatgttggccaagctggtctcaaactcctgatctcaggtgatctgcctgccttggcctcccaaagtgctgggattacaggcgtgagccaccgcacccggccttgctaatttatttttagtctatcatatttatcaaataaataacaaacgaaaatattatggtaggagttatttaaaaattattggcccggggccaggcgaggtggctcacacctgtaatcccagcattttgggaggccaaggcaggcaggtcacctgaggtcaagagtttgagaccagcctggccaacatggtgaaaccccatctctgctaaaaaaaaaaaaaaaaaaagaaaaaaaaattaattgggcttggtggcacacgcctgtagtctcagctacctggggaggctgaggcaacagaatcacttgaacccaggaggcggaggttgcagtgagccaagatcatgcccctgcactcccgcctgggatccatctcaaaaaaaaaaaaaaaaaaggcagataaagaaaaaaaatagtaatataaagagaaaataaaaataaattatcctggcaatagagtcttgcatatttttcagctttccttgaagctgagatgtgctcctgacctcaaaggaccagtcccttgggccagagtattgagaaccatttacctgggcctggagctgtggagagatttcctgactgtacatgttcccatcaggctaggccagccaccgaacatggccttcagggcaggacagcagaactagggccctgcctggggtacctggtgctggtccaagttttagagccagagcatctgccgaagtttggggccatcctggcgcaagaggggtgcagggtggtggagtcctggtcctcgggctgatgggctccaaagcctctacaggaaagagagggggagagaggagaaggagtctacaggaaggctgctgggagaggctgacctgcaggggtgtggtggagcctaagagcaggtgacctgggaagacctggggcgggagtatgccgaggggcaggagtgggggtgagggtgggcagtgattcacagatctctctgctgtcaccaggggagggcaagctattgatctggagtcaagctgggaagaaatcacctgtcctgcacctctagaccaacaaaaggtaaactgagtcccagagcagggaagggttgctaacactcaagggtcaagcagcaaagtggtgtgacctgaaagggaagtcatgagagacaaaaggctgagggcggcacaaggaaaaagctgggaaaataaggctgtgcagcgagaatggaccaacactggcgcctcacgcacatacaccccacttcccagcgggtgccctggggcatctcagaagccagcacagcctaggcctgctgcagagtgaaagagtgagccctgctcatgctgaagcaacaggagctcatccaaggtggggggaagggccagtgttgaggcagccggggcatgtgcctcaggagtggagcctctggtgcctggtgtatcactaggagtgagtggcaacgatgtggaagtggccagacaccccatgacccaggagtcaaggaaccatgctctttgctgtccagtcccccaaaactaacaactgcacttccacgtgaaggaagcagaatgaccccttctccccactccctttatcctgaacatcagcaggtgggcccaggactaccaggcaaattctgagatccaggacctattgaggagtagtgatggcagcaactggccaaacccacactttccaggcagccacaggagctgggcatggccgaggcctacagacatgcaggcagtgccccaagggtgaggacaaggtagatcatgcctaattcctgccatgagtctgactgcatgctagagttttgcttgcttgccttcagtaatgcctctccatgtttatggaatttccagttctcaataaagtgtagatacagtatataaggcaatgttactttgtgtgtaacactgaatgtgtattttgattttatctgcagatcagtggctttgattcaggcagcttcaaaggaattgtgatcaagttatgataatttagtcaacaagcaggtcaatgagggaggtaaactgaggcagggccctccatgtgatcacccagacaaatgcttcatgcccaatgccaaggcaaaatattaggtgattatcccaaaagattacattaaagcgtattccataattaaatatacatttcaaatttagaagttagttttaaaagctcatcagttaaggtctggaacataaaaaaacatttcataaaattaaggtttcggccgggggtggtgactcatgcctgtaatcccagcactttgggaggccgaggtgggtgggtcacgaggtcaggagatcgagaccatcttggctaacacagtgaaactccgtctctactaaaaatacaaaaaattagctgggtgtggtggtgggcgcctgtagtcccagctacttgggaggctgaggcaggagaatggcgtgaacctgggaggcggagcttgcagtgagcccagatcgcgccactgcactccagcctgggtgacacagtgagacttcatctcaaaggaaaaaaaaaaaaaaaggaaatgattcctgaaagtatatagtcttttgctgggcgcagtggctcatgcctataatcccagcactttgagaggccaaggtgggcggatcacgaggtcagatcgagaccatcctggctaacatggtgaaaccccgtctctactaaaaataaaaaaaaattagccgggcatagtggtgggtgcctgtagtcccagctactcaggaggctgaggcaggagaatggtgtgaacctgggaggtggaccttgcagtgagccgagattgcgccactgcactccagactgggtgacacagtgagactccgtctcaaaaaaaaaaaagaaatgattcctgaaagcatagtcttttgttgggcgcggtggctcacgcctataatcccagcactttgggagaccgaggcgggtggatcacctgaggtcaggagttcaagaccagcctcgccaatatggtgaaaccctgtctctactgaaaatacaaaaattagccggtcgtggtggcgggtacctgtaatctcagctactcaggaggctatggcaggacagtcacttcaacccaggaggcagaggttgtagtgagccgagattgagccagggcactccagcctgggtgacagaatgagactctgtctcaaaaacaaaaaaccaaaaacaaaaaactcctgacctcaggggtgcctgtaatcccagctactctggaggctgaggtaggagaatcacttgaactcgggaggcagaggctgcagtgagccaagatctcaccactgcactccagcctgggcaacaagagtgaaactcagtctcaaaacaaaaagaaaatatagtctttgtaaaaatattttattcattcatcacgtgcatttccagcatgagatcttcctccttacaggagccatgttttgagtcactcaacacagttgttcaaaatgcagcatcttctcttccagctaaattcctgttgcatttgtattaaatttgcgtatgaatctgttatgatgctattagatcttttatctcaaatcacaaggttttgtttgaaatttgagatttttaccttcataaacaccttttgccttttaaatgatttctaaaattctcatttgcaattatacacaacatcgtaattatgagttctgattttcaggggtgattataaaaactaacaaattaaattgtaggttattctgagtagccaatactagcattgattgagtttgcatcagcctaaagtgtgtttcccagattgtaactttgttgtaaaaaattaaatgttcccacatattcctcttcattgctggagacaattctctatgaatattacacatttctgcatgtccaggccctagagaaagacatttatatccaatgcaagatgttgctttggctgcaattttcactgtgaagaaaaattacctttttttctcagactcaggctgtatatatatgagttcatggggccaagcctggttctggggtgggcctggagccttgggccctggaggccagcctggaccttggcctgcaggggctggcctagagctggggtggtggtcccagagcttgggttttatttctatgttacactcaacatgctgtgatctctcatgtggattcctcagctcttgtgaaaggatttttgtgtgtgaagatttgttcaaattgatgtttctgtgaggggccgagatccagaaagtctcattttatcacttgctgacgtcacaccccacggctactgtggcttttatgttttgttagtattccaccatattgtggcaagcctgcaattcaattaatattaaaaatcaatctgaatgagataatctcttaacagatatcccactctgaaatatcagggtggcttctgttttgcttatgtcttgactttgctttaagacaggtcatagcctgtgcatctcactaagcttcacagtgacaaggacatgttctgagctggccagtgtgtggcacacacccagccacgcctgcagatgtctgctgaaaggcagctttatgaccacccttttgctttgtgcctgtagagctacgaaaaccgtagctcactgagactcagttaccgaaactatcaaatgacaaacaagtcaagggtttgagatttttccctcaaggacatatcttctgtgaggctttcagctttcttaaaaaaatattttatttgaagataaaactctgctggacacactggctcacgcccataatcccagcaatttgggagtccgacacaggcagatcacttgaggtcaggagttcaagaccagccttgccaacttggtgaaactccctttctactaaaaatacaaaaacttagccaggcatggtggtgcacacttgtaatcccagctactctggaggctgagtcaggggaatcctttaagcccgggaggtggaggttgcagtgagccgagattgtgccactgcactccagcctgggcgacagggtgagactcagtctcaaaaaaaaaaatacaaaataaaaaaataaagagataaaactgacttgttatatgcctgttaaaatgggtctcctccttatttttggtgtgtgcgtgtgtggttttttttttttttggcttcctctgttcattttcactcatctcccctttccctcttcagaggaccagatttgcccatcttctttcaagcagatgactgagtcaatcccacattacatatgaggaaactgaggtaagagtggaaataccctgaaaaaacaattttcttcctctgttaaaaggagataactatttttttccatagaactgttgtaaagatcagagctaatgtattcaaagttcctagtgaactacctagtttatacgtattgaaacagagagagctgatgctgatattttgatattccagattacttggtgatatgccttatcatatcatagaagataataaatgttaatttatacaagcattatatatatatttgcgtatatatacacccatattatcttaagaaaagttagaacctttttctctctctgtacgtttcttgcaactttatgatattaaacaaatggaagtgttagaggtaacttccaataggaacaaggagagactaggaaagggaggagaagtggctacattttaaatgacaggtaacattgtgtccggaatttattccttgtggtgggttcttcgtcttgctgacttcaagaatgaagcagccaacctcgcggtgagtgttacagctcttaaagatggtgtgtgtgtccggagtttcctccttcccatgggctcgtgatctcacggacttcaggagtgaagccacagactttcgtggcgagtgctacagctcttaaaggtggggcggacccgaagagtgagcagcagcaagatttactgtggggagcaaaagaacaaagattccacagcctggatggagacccaagcgagttgctgacgctagcttgggtggccagcttttagtcccttatttggccctgcccacatcctgctgattggtccattttacagagtgctgattggtgcatttgcaatcctttagctagacataaaagttctccaagtccccacctgccccagaagcccagctggcttcacctctcaacatggtcagtcttttttttctttttttcttttttttttttgagacaaaatttcgctcttgttgctgaagctgcagcacaatggcatgatctcaggggctcactgcaacctccacctcctgggttcaagtgattctcctgcctcagtctcccttgtagctgggattacaggagcctgccaccaccctggctaatttttgtatttttttagcagagatggggtttcatcatgttggccaggctggtcttgacttcctgacctcaggtgatccaccagcttcggcctcccaaagtgctaggattacaggtgtgagccactctgcccagcctggaatttatatttctgacaacttgctaggtggtgctcatgctgctggtctgggatgtttttgctcctaagctgggtctgcctgcccagcgcagtcaggccaaacacccacaccaaggtttgcagcaggagaaaagaggtgtttatttgcagggtgccaagcaaggagaatatagcagctcctgctttacacctgacctcctgatggcttgcgagtaagagtttgttttgttttgttttgtttgagatggagtctggctctgccacccaggctggagtgcagtggcgcgatctccgctcactgtaagctccgcctcccgggttcacgccattctcctgcctcagcctcccgagtagctgggactacaggcgcccgccaccacgcccagctaattttttgtatttttagtagagacgaggtttcaccgtgttaggcaggatggtctcgatcttctgacctcgtgatccgcccacctcggcctcccaaagtgctgggattacaggcgtcagccactgcgcccggccacaagtaagggttttaaaggcaggggtaaatttcaggaaaacagaagttacaacaacattgtgaactgatacattggtttggcctaaaaaggtgggatagtttgaggtaggagattaccggtcataggtatattcaaagactgttttgcaattgatgaaaaaagagtttgtttaaacatttgggatcagcagaaaagattattagctctggcacgtgggcacggcttcctccaggtccctcaagaataaatttagagccaaggacaaacggagttcggggttcagtcctcagctcccccttatctgtgttctactcgccagcggatctgctcggtagggagtctgggtttctgaaaaacaactcagagacatatgttaaaatgttgcctttagtttcaaatatcttatggctagaacttccttggctgttgttttaagctgtgattactttctttcttatcaagttgcttgcttctcagggctagctaggtgcctggaatttcccttgaaggaactcaatattttcctttatttccatggatgggggtgcagggtggtggaatggagggggtgcaggccccaagagggttccctgctccattttagggaccgcacttgtgaaacaatatcctctgagtaggagattcaattttttcccgtgacaatcttaaggtctatttcaacaaagggccagatagtaaatttacttttgttctataggctgtaatgtctctgtacagctgttcaactcaatcacaggaaagcaatcatagataaaatgtaaaaaaatgggtatggccaagggccgggagcagtggctcacgcctgtaatcccagcactttgggaggccgaggtgggtggatcacgaggtcaggagatcgagaccaccctggctaacacggtgaaacactgtctctgctaaaaatacaaaagaattagccaggcgtggtggcgggcgcctgtagtcccagctactctggaggctgaggcaggagaatggtgtgaacgtgggaggcggagcttgcagtgagcccgagcttgcagtgagcccagatagcgccactgcactccagcctgggcaacagcaagactccatctcaaaaaaaaaaaaaagaaaaaaaaatggttatggccaagtttaattctttgggccatagtttaccaaactcctgatttagatgattagcaatagtcctacaaactctgaactctgtatatcaaggcagtatataattaaataactgattttaattactataggacttcaatgaaaggagagaatgctatcagttgaaatagttttctgaagagaaaatggggccagagacttcaggaatcagcaatatatttactgtctgttaaattaatcgccttttattacgtgctaatcaagttctgctttatttcatatgacaagagtggttttgaattaagtaactctcagacaattgtttcagcaaatgatttagttctcatttccatgcttacgtataagttctttcactcaaaaaaaaaaaagaggaaatctttaatttaggaataaaatacagaggattgcttcaagtttgatttgttttcaaagcctaaatttataacttttatgttgcccttgccaatgattatttgcagttacagtctgtagtttcacatcattaataactagaaagaaaaatgggctttttatttggcttcaaagtgggtgacgagttttggagcttcatctgcttgccgtgttgctattgatgccaatatatttgcgacttcccacttgcaatatcattatcaacaggtagagaaagacataatggtttcaatctccttgctgacaagcacttctctacacttgttaaatcacagatttagctaagaaaaatgaaaggaatattccccgttggctgtgaatttataaaaattgctttctttgacagacagtcctctgtttcctgtctcagggaaaatacacaaagtataatgaacactatggaggcatttcctaaacttacatctcattattcaatgcagggagcacagactctgaagagggaaaccacaggggaaattacacataccatttgtcaacttacattcctttaagcaaaatgcaccaaattaagaattcgggacgggccgggcgcggtggctcacgcctgtaatcccagcactttgggaggctgagacgggcggatcacgaggtcaggagatcgagaccatcctggctaacacggtgaaactctgtctctgctaaaaatacagaagaattagccaggcatggtggcgcgtgcctgtagtcccagctacacgggaggctgaggcaggagaatggcgtgaacccgggaggcggagcttgcagtgagtcgagatcgcgccactgcactccagcctgggcgacagagcgaaactccgtctcaaaaaaaaaaaaaaaagaattcgggacgatagttttgcattgctgagtacatttgaaaatcacttgaggccaggtgcggtgtctcacgcctgtaatcccagcactttggaaggctgaggcgggtggataaactgaggtcaggagttcgagaccaggctggccaacatggagaagtgatggcgtggtggcccggcttggtggcaggcacctgtaatcccagctacttgggaggctgaggcaggagaatcgcttgaacccaggaggagggggttgcagtgagccaagatcgcgccattgcactccagcctgggagatggcccaagactgtgtctcaaaaaaaaaaaaaaaagaaaagaaaatcatctggatgctggtcaaagcttaaatgctaaaaagttctacctcatgagtttgttttgctggtatgtgtggaatccacctctatctttctcaggctctctctcttactctcttactccctccctctttccttccttcctccctttcttccaccctccctctgtctcttccaccctccctccctctcttccttccttccttctttcctgtacattctcaccagctacaaactttggaccctcttgacaaacgtttttgtgtcttccatgaggatgattactactagcttgttgctgatggtaagccacatttcctgtctccatattgaagaaatgaaatggcagcttgaaggcagcaggacagagattcgctgccaaacaaccaaatcagctgtaactgcctgttggtatggaggacagaagggctccaggctgtatcatcattgagatgcaggaattcaagtgagtcttccgtatttgaactggcctggagttggtgcttgggagttgatggctacttctacatataactacacaaagaactggcttaatattaatgctcaagtaaacgagtcactaaacaaacaagaaaaacaagaccaaactatgaaatctgttgttaaaagtatattaaaattcagattgaaaatgattgaaatcaattattaaatatgtttcaaaaaaagaaagcatgctacatccatttggtttgttttcataggtaatatcaaactgctaaatatcaccttaattcagtcattgataaatgtgtgcaatgaggtgtagcccacaaagcctttaatcagtgtgaccattccaatatctcatggcctttaattttgcttctgttcggttatcaacattggatgttataacatcaggtggcatgatgtgtgacatttgtctgtcattcattcattccattatttattgaatgcctattacagcacagaatttgacatgggagtgggagagtaatcgtgaacaatactagtaaaatgcctgccctcatgaggattatgttcctgttgtcatgaagttgtcatctccttctagatgataaacaagaaacaaataaccaaaatgcactcaaagaataataataagggcttgaggaagttaaagcactttaagaaagttaaaaaaaaaaaaactagtcatggggcagtggctaattgagtggtcagggaggcctcttcacagagttcacattttgctgaaaactaaagaagatccagccttgagaagatgtggaaaagggaacagcaaatgcaaaagcctgatagaggaagagctttggatggtgatatttcaacaagaacatcctcaaggctggagcagggtgaacaggagggaaaccagtagcatgtggaataggatcaaatgagcattcaactctatttttccagggattggagaatcagataaggccccccatgtatgctgtaaataaccaagactgaccttctacattaaaagagagagatgtgtctttccttttgaatgttaaaaacagtttaaaagtctttacaaaattaccaaagacaaataatatcacatatatcaaatttatccatttgattaataatttttaagattttgaagattaataatttttaaaattatttttatttcatgattttgcataaaggttgtgagtgaaatagatactgtgattggagaaaagataaggagacaatgtatatgtgtctatttggcagggggtggggacacatcataatatatatttggtatgcatcctatctagtttctaattaaaaccaaaattggctgggcgcggtggctcacgcctgtaatcccagcactttgggaggccgaggcgggcagatcacgaggtcaggagttcaagaccagcctggccaatatggtgaaaccctgtctctaccaaaaatacaaaaattagccgggcatggtggtgggcacctgtagtcccagctactcgggaggctgaggcaagagaatcacttgaaccagggaggcagaggttgcagtgagccaaaatcacgccactgcactttagcataggagacagagcaagactccgtctcaaaaaaaaaaaaccaaaattataatatgactcaccacagcaacccatttacatcttctgttacatggcaacaaggaactaaatattaatcataaacccccaaagacattaatcctaggatgtaaagtcactccctaaatcgctacatctttaagtttcatgggtccactccttgtctatgggtgatctctgttgtagaatttgtcccatcccacttccttgggctgcttccctcagtaaactcacacattcactctctccaataaaatcagaataatgatgaagtggtaccactttcttgcttcattggcaaataactatggaagctaagtgtcttgttaagaactatattagcagatcataatgagccctagacttgctatctcttaaacattgatgaaagataagatgtaaaactagcagttgctgacttgcattaataaagtgttaagaagggcgagagccaaggattgccacagggaggaaattaagtaacccgcttactgcatttccttgggcaactgtagataaaatgtttggcttgggtaaagaactgttaaaaccttaaaataaaatttaatgaccccattttttaaaaacttaatttttaatcaggtttttaaacacagtataattccttcagtatggcagctgtgccatagagttcactctatgtaatgtttttgtatttaaaaaaatagtttgtactttaaaaaaatacatagctgtattgacatatagtttatataatgtacattttatccatctaaaagtaaaattcagcctcccaagtacctgggattacaggcacctaccaccatgcctagctaatttttagctagctaattttttagctagctaatttttagctagtatttttagtagagacagggttttgccatgttggccagacttgtctcgaactcctgacctcaagtgatctgcccatctcagcctcccaaagtgctgggattacaggtgtgagccaccatgcccagcctgttttgtggttttgatttatattgttctaatgacaaataatgttgatcatcttcctatgagcacacaggccaatctttggaaaaatctttagtcacatttattgctcatttttaaactgggttatttgtctttttattattgagtggtaagtgttctttatacattctggatataatatcttaacagatatatgatttgcaaatattttctctcattctgtgtgtcgtcttttcagtttcttggtagcatctttggaactacaaaaattctggccaggcgcagtggctgaggcctgtaatcctagcatttagggaggccaagacgggcagatcacctgatgtcaggggttcaagacaagcctggccaacatggcgaaaccccgtctctactaaaaatacaaaaattaacctggtgtggtggtgcatacctgtaatcccagctactggggaggctgaggcacgagaattgcttgaacccaggaggcagagattgcagagagccaagatcacaccactgcactctagcccgggtaacagagtaagactccacctcaaaaaaaatttttttttctttaaaaaaaaattcaattgacaaataatgactgtgtgtatttatgggatacaatgtgatatattcatatatgtatcaattataggaagtccaacttatctattttcttcttttgttgcttgtgcttttggtgtcatatctaagaaagctaaagtcaagaagatttttttcccctatgctctcttctaagagttttataattttatctattaaattttagtatatatttttgaggtaactttttgtataaaatatgaagaaagggtccagtttcagtcgttagcatgtgacatccagttttcccaacaccatttgttgaaaagactattatttccattgaacagccttggcattctggttgaaaatcaactattaatgtaaacattgatttctagacccttagctgtatcccattggtctatatgtgtatccttatgccagtacaagtctgtaattattactatagctttgtagtaaattttgaaatagagaagtgtgcatactccaaatttgctcttcacttttgagattactttgactatcaggagtcccttgcatttccacatgaatttttggatgggcttgtcaatttccacagaaaaggctgttgggatttctatagagacatggtgactgtatatcaatttggaaagccatcttaataatgtctcccaatctctgaacattggtgtcttgtcatttatttactcctttttttttttaccttctttcaagtatgttttgtagttttagggtataacttttgctctttttgaataattaatttctaagcattttcttttttgatgcaattatcaatggaattgtcttaatttgaagtgttcattgctagagtagagaaatacaattttttttttttaatttaaaggagtttaattgagcaacaaacacttcaagaatcgggcagccttcccaggcagagtaggctcggacactccagcacagtcacgtggtggaaggtttatggacagaaaatggaagtgaggtacagaaacagctgggtttggctgcagcttggcatttgccttatctgaacatggtttgaacagttggctacatttgattggccaaaactcagtgattggcacaagtgtagtctgtttacacctccacttgtcacaatatacagacaaacttttaggccaaacttaaatatataaggaggcagctttaggctaaacttgatttcaacacctgtattccaacactttgggaggccgaggcgggaggatcacttgagcctagaagttagaggtcagcccaagcaacatagtgagaccttgtctctgcgaaaataaattagccaggcatggtagcatgtacctgtagtcccagcttattaggagactgaggccagaggatcatttgagcccaggagttcaaggttgtagtgagctacaagcgcgccactgcactcctgggcaacagagaaaaagcctacctcaaaaagaaaaaaataatgacataagcaattatgtggaaataaggtcatacctgtcaaagtaatcagctgaaagcagttgcctctgaggtgcaggaaagggggaaagtggagataagggaactacttttctttaaaaaaaaaaagataaaactaacacttcaagccaggcaaagtggctcacacctgtaatcccagcactttgggaggccaaagcgggtggatcacctgaggtcaggggttcgagaccagcctgactaacatggtgaaaccctgtctctactaaaaatacaaaaattagctgggcacgatggcgggcgcctgtaatcacagctactcgggtggctgaggcaggagaattgcttgaacctgggagacagaggatgcagtgagccgagattgcaccattgcattccagcctgggtgacagagcgagactctgtctcaaaaaaaaaaaaaaaaaaaacaaaaacaaaaactaacacttcattacctctgaatggacattaaaaaatattttaataaataaaaaaagatttaatacttcaaactatgggcacacaaaaccttgataaaaataaaaacaaatttagaaatctattattattattattattattttttttttttttttgagacggagtctcgctctgtcgcccaggtcggactgcggacttcagtggcgcaatctcggctcactgcaagctccgcctcccgggttcacgccattctcctgcctcagcctcccgagtagctgggactacaggcgcccgccaccgcgcctggctaattttttgtatttttagtagagacggggtttcaccttgttagccaggatggtctcgatctcctgacctcatgatccacccgcctcggcctcccaaagtgctgggattacaggcgtgagccaccgcgcccggctagaaatctattattaataggacagcatgttgagagactttaaaggagttttttttaagtatttttaaaataatctcaaatttatagaagtcttggaattaaagtacaaagaacttttgttttgctaaatgatttgaaagttcctgacctgactccctataacccctacatactgtatgtcttctataaacaaggactgaatgcaataaaattgtaatatagctagaaaaatcaggaaatcaacattaatagatttctaccatccaaccaacagacctattcaagttttgccaagtcaggatccagttcagaatcaccactgcacttatttctcacgtctctttcatcttcagtctggaacagttcttcagtctttccttaactttcatgactttacacttctattacaggccaattattttgtagaattttccttaatttgaatttgttgctttaggattagattccaattatgtattattggcaggagcatcatagaagtgatgctgtgttcttcttgctagactatcaggaggcacacgattgcaatttgtcctattactgaggatgttcattttggttgcttgattaaggtggtgcctgccagatttttccactgtgaagtgacttccttttgtaactaatgaataatttgtgaagagctgctttgaaatgatgtaaatatctgttgacttgaaaatacaacaaaattatactatgaattgaataatacatctaaattaatttgcattttatcaatgacaaccagatccacatacttttgtaaaacagttgctggtgtgtgtgcgcaacaggttgttgacttaggcaatgtgtggaatgttctggattcctagaccccggacagtagctccaagacagttttgaactttcaagtaagacaaacttagttttgatttccagttgtacacttagaagctatggatggtagattctttgttggggaaaatggcagcaattctcactccctgtgtctacccctttggttgtccccttccataccggctggccatgcccttgtgacctgctttggccaatgggagaatagcaaatatgacataagtgagacatgggaagttcttgtgttgctgcccttatgctgcttttgaaactcaacccctatgttcaagctctcctggataatgagacttgtggtcgcattcccatcacccagctgacgatgagctcctcctgtccctaaaatatgaggccccttagccatccagcccccatccagttattgagaaacaagtattacctgtttgaaatcataaacgggtggtttatgatgcagcaaaaactaacttacatacaacatgacctcatgtgggtttcttaatttctctcagtctcagctttctcatctataggatggagataaggcaatcaacctcactatttagaggattaaatgagaaaatatatgcaaagtgcttggcatagcataaatactcaacacatatggtaattttttaaaaaccctctatattagtcccttttaattaaaattttaattaaaacaaaagaaaaacaaaacaaaacaaaaacctctgctgggtggacgaggggcagccctcaggctagatgcactgatttagtacttttaatagtggcaggagtcagacaagcccgtaggcagatagtggcatgtccccaatgaaatccaactttcaaaccaaaggcagtttaaagcccgaaagctaagctacaagtcttggataaatccatggaccgagctgagaacatctcttcctgttggtgcactttcctctgactgatccccacccttcacttactttacatatatctacccttccctaggtggttttctacactgtcatgccacctttgaatggttcctttgttttagccttttttgtatactcgtaaaccaatcagcatgcagtccccacttctgagcccataaaagccccggacccagccacgctgagagagagaccacccaacttcaggtcagggaccacccttgcatcccctctcctctgagagctgtttcattgcttcataaaactcttctctgcccttttcacccttccattgtcagcaaagggtatgaagaaggcagtaacaccatagccctccacccctccccgactatctgtgcccagtggcagccccttgccatgagaggcagtgcagggccaggccagccagggagcctccggcaggagcaggcaacaggactgacagagttgttaacacaccccccattcattgttaacatgcccgtttgtcaggctgctgacggtgggactaaaagagctgttagcatggctgtaacatcccctctggggcttcagagtcgagtgctttcctgtttgggcgccaccaagttcccttcatctgcatgccagagttcacccccggagtcacttccgacaggcctgatccagctgcaggccccaaagggagcccgctcctgcgccagcacttggagttgctggcaagatgaggcactcacttgatcacacaccccctcctactggggctgagcatgcagtctcggtggctgcaggatccccaccagagtgcaagcccaagtgggcagggcacctcctgcctggggcagagctaggcatgggcaggggcatcgccagccagaagtctgcagttggaaaagtgtccgagaaaaatcctgcgtcactttggaagcagtcttcctatcctagaatgccagagggcaagcatctgaaagatctggaaggatgaggcagcaaaggccaagatgtgaatgtacactgcccctgtcagaggtgatcgaaccagagcgattccatcttgaataggggctgggtaaaataaggctgagacctgtgaggctgcattcccactagcttaggcattctaagtcaggatgagatagaaagtccgcataagatacaggtcacaaagaccttgctgataaaacaggatgcagtaaaggagccagccaaaaccaagatggtgacgaaagtgacctctggtcatcctcactgctcattatatgctaattataatgcatttccatgctaaatgacactcctgccagtgccaggacagtctacaaatgccatggcaacatcaggaagttaccctatagggtctaaaaagggtaggaaccctcagttgcaggaattgcccacccctttcccggaaaactcatgaataatccaccctttgtttagcatatgatcaagaaataactgtaagtatagtcagtcgagcagctcctgccgctgctctgcctatggagtaaccattctttcattcctttattttcttaataagcttgctttcactttatggacttgccccaaattccttcttgcaggaggtccaagaaccctctcttggggtctggatagggacccttttccagtaacatccccatcacagccctaatcactaggggaccctctaggctcttcctgccctccccagactgtctcccttaaacatgctggatgcaggggtgcatcagtgactccgctggtgcctccaggaaaataaagtgtggacctctgtggacaagaaacaacccaaagtaaagacgactcctcacaggcaggatggatatccagttgtatgtatgtcggtgtgctggggccgggaggctcctaataacaatgttaccgctgcttcacgtggaagaaagctgaggctcagagagattaaggaacttgtccagggccataccggagtccaggcctgtgtgctgtcatggtctgaggtttgaactccaaccgtctaaggagctgggatagaactggggagggagtgtggtgggtgggaacagcgggcagatagatgctggctggtctccgaggagcctaggttcggccagagggacaacaggtgaggaaaacaggcctcggggtggatgagtgaatactcagaggatgggcgcagacccggagggccgtgaaaggtgacagggttattacagtcttggttgcataagggggtaactagcggtttcttggctgaaaaagaggaggggggctacagcttcccccctccaagggcggagcacgcagccgctcagcaggctgccacacagggtcccccacctccgcagctgggggacctgaactcgccaataggaggttcctcctgcacgcgcggcttcaccctccctccagggctcccgttgcatttcactccctgcctaaggtcgcccgccggtgagggcggaggaggaagaactgcagctcctgaggacagaatctgcttcaaggcaccctgaccggcgcccaaccccaccccggctgcggcccgccgccctgatccccatcgcgctgcacggtcttcccttccaacaccgagggcgctgcaaggacgccctgtccctgccactcattcatattaatgactcctcccaccatgctttcctcaggtgtgttccgaccgctctgcccgaaacattttcatcccacactcttacggccacctctccccaagttcccttccgtctgggcaaatcttgtcctttacccggcactggggtcgctccagagctttcaaaccagcttccccagggcgctgtgcagggccgggcccctacaatttttgtatattgatcttgtaccttgccgtcaggctgaacttgtttattagttccaataattttttttagtggcattgttggggttttctatataaaggtaatgtcatctgcaagtagagctaattttacctcttcctttccaatctgaatgcctttactttattcttcgtttaattatcttatcttggctagaacctccaatacaatggtaaataaaagaggtaaatgtgctgcagtgagtgcttaaagttttatgttgccttagcatccattttcaaatatgtgtttaactttctcaaaccagaagcagggttcagtcacccttgatgcagtttcctgtactataccccccaaatggctccaggtggtgaccagaaataaaaacttggaggcatctctgtctcgtagcaggctgggctcccagctttcctgctgcttcctctaaacagaccatttagacactttcagtcacaatgtgacttcctagtactagtgcctgcttgctttaagcccatcaatttaaagctccttgtttatataatgccctggacccaataaaggcattgacctccgtgtgtgtgtgtgtgtgtgtgtgtgtgtgtgtgtgtgtgtgtgtgtgtgtgtgtgtgtgtgttttctaagcatgctgtgtgccccccagggaactttcacactgtggtcatgtcattgaagccacatctgcaatctgacccatgcaggtggatctcctgctgctgcgcttctgtctgggtctctggtggctgcagaaacaatggctacaagctgagcagataaagaaactcagagagttcattctaaacaagtgaacaacctcttcttcctgatctaaggcaaaaagcatttaacctttcatcatttatttctccacaagtgtggcatgtcatcattgccactcactgacccacacactcatggttcatagcctgagaaatagtttgcaaaggcatatttaccttcattgaaaccttagaaaacatttataaaggcagttcaaaaatcaaccttaaaatatgccataaaaagacagagagaggtaagaagatactcatgaaatcagtcattgtctcaaacaagaataattttagagaaagtggattgggtccttctttccctggttctcttgcttttttctattctcttctgcaagcaataatccttttgtctggcttcttcattatttcaaaggagaaagtacaatatcagcatgcattcacctatactgtcaattccagaaaaaaatagcagagttaaatataaatggaccttagtcatatttaaccattgctctccttgacaatccaaagcttaataaagtacatctctttgcatttagaaattcatatattcatactcatactgttaacctactaaaataaaaaagtagatggaaataatatacatggagctaaagtcaatattaaatagtcccagacatatggtttgtgactaattattaaacataatatatgaattcttccggtgggttatacaattttaattggttgattaaaggaccattctattcttcaaaggagataatcatgctaaattttaagaaaaattacagtggaggtattcatttatctatgtctttataaaaatgtaatataaaatgtttatgcaaaggaggcctgtgagagaggggagtgtaagggtttaataagatatttggagtagtttcatcccatgaccacacatgttctgctttaccatctgcaatctcattagctgtccatgaagatgctgtgctgaatgtagacctgaaatttagacataagcactcacatatatgaaatatacattgctagaggagcaaataaacaaagaagaaaaacattttttgatttgtggcttcacttttgaacaataaccaaaaatattctacatgctcaaaggaaaaaaaaactcattttattcttatgagaccaaaggattttattcttacgagaccaaaggaattgacaacagaaggtgaaatacaatgcaaccagcctgggaaatctttctgcttggttcagctgggccatggacaatttcaaaacgaagcaatgtgaaaacagcacattaatgaatggatggataaagaaacatggagagaagatacattactttggctaccagaggtacaaatgcaaaaagattctccacttttgactagtagaactgatgatggatttaaaatcagctgcacattgagggatttttgttcaagtgtaacataaattatgttacaatatgaggataaaatatgttattttgggctatgttttagtgcataaacactaacaacattaatgaatgttataataatttacttgaaagatgtttaatctatttgtaaatagctctgtcacctgctgaatggctttcatatgtttcaagtaatatttaatttctaaagagtatcctagactttactctgaggatttattatattaactctctcaaagagcccttatattgtaaagagagtgttatctagaaaacaaacctcctgggtgtcacacgttgctagttatgatattgcttaaggtaaaatgggaaaattacagcccaaggctatttcccagttacctctgcttagggacaataactgaacggccccacagaaaacacgttagggtagaaggggcctgttttccaggaattcctgcttcttcatgttaagtaccctcccaaccaagtgaaagcaaagacttcttagtagaaaggcaaattcagcaaactactttccttttttatctgagataaaaattaagtgagtctttgtgtttttgtgtattgatgttctcaagttttgcccttgtttattttctgttctttattaatgaatcagtagttccattcttgagttgttttgaattatttcacctggaagaagacaaatttaagaagtcctagtaagtaagcatgaaaaggggtcttaaatgagtatcaggaatcaaatgcactgagtccccgggtgagtattcaacccctggggactgagaagtaatcctttccactgcctctattttatttctcttgaagaacataaaaatctaacaaaagtgcttagctatccaaaattatcaaatattgaaagaatgattttttttccacatcaaacaaaatttagttaaatggtagtttccacatagatataaaatgttgagcagcattagagattaaccctgtgaggtgggggagataaagaaaggtttagtggtggtacaattagctgaggagtcaagagaaatagaaaacaaaaaatcttctattttgtcttctttggatcatgaatccattgttatgttttatttttattaaacaattatttcccatgctggaagagtgaaagagttgagccatcctaaggaacttaaggtgtgacaatttacagagaagaatagttgtaacattgctcatttactctgagtataaacatgaaaaatagttttaaaaaatatggtgaaataatttattccacagagaagtcatggagctctcttacacatcatattgtatactaatagctttgggtgggtggtcttcaggtgatagcacagaaatggagtacgaatttgcagggaaatgatacaaattgaatcaggcttcagtttaccagctactgattgctattaacagggcattttgatgtgagtctccactaagcatgtgagttagaaaatagctctaaagaccatccttgatggatcattactttgagatgcaaaccccagattgcattattaaaacatcttggaatcaattctgtgcatttccaaataagctctggcatggatatgaccacatcattaatacagtttacttctctggatcctagactctttttttttttttttttttgagatggaatcttactctgtgcccaggctgaagtgcagtcggctcactgcaagctccgcctcctgggttcacgccattctcctgcctcagcctcctgagtaactgggactacaggcacctgccaccacgcctggctaatttttgtatttttagtagagacggggttttgccatgttggccaagctggtcttgaactcctgacctcaggtgatccacccacctcggctttgagaacaagaacaccatatctgctggtctcaaactcttcacctcaggtgatccacagtcctcagcctccccaaatcctaggattacaggcgtgagccactgcacccagccaaaaaaactgatgctattttctatacaccttgcaccttatggatgtgcctaccagagatctggattataaccctaccttgtcaccataaaaaattcattcttattggacactgacatgaaagccttatgttacgttttgtgattaagcagttttctcttacagcttatttacaagggaaagagaaaggaaacaagaaatagtttcaaaaaaacagcccaaatttcagtaatcattaaaatcaacacaattaaatactctttttttggaatgaaatttcgctcctgttgcccaggctggagcacaatggcacaatctcagctcactgcaacctgtgcctcccgggttcaagcaattctgcctcagcctcctgagtagctgggattgcaggcgcctgtcaccacgcctggctaatttttgtatatttagtagagacggggtttcaccatgttgaccaggctggtcttgaacttctgacctcaggtgatccacccgcctcggcctcccaaaatgctgggattacaggcgtcagctaccactaccagcaatgaaatactctttttaaaagccttgagggaaccgtgtaaagatctcaaaactctaagatattttcacatcctgtccccacattccaaggttaggaagattgagaaggtattcatttactattagttatttattttattgttatttatattaaaaatctcaaggcaaaatattaggtgattatcccaaaagattacattaaagcgtattccataattaaatatacatttcaaatttagaagttagttttaaaagctcatcagttaaggtctggaacataaaaaacatttcataaaattaaggtttcggctgggggtggtggctcatgcctgtaatcccagcactttgggaggccgaggtgggtggatcacgaggtcaggagatcgagaccatcctggctaacacagtgaaaccccatctctactaaaaatacaaaaaattagctgggtgtggttgcgggcgcctgtagttccagctacttgggaggctgaggcaggagaatggcgtgaacccgggaggcggagcttgcagtgagccgagatcgcgccactgcactccagcctgggtgacagagactccatctcaaaaagaaaaaaaaaaaattaaggtttcactgatcctctgtcccagcagttctaatcccacgagaactaaaaaacataggttcacatgaaaacttatgatagttcaaggcatctttatttctaacatctaaacatcccagctgtccatcaataagaaaatgggctaacaaatggtatacaatggaacagtactcacaataaaaagaatcaactttttttttgtttttttttttgaaggagtctcactctgttgcccaagctgaagtgcaagtggtgagatctcggctcactgcaagctccacctccgggttcaagcgattctcctgcctcagcctccggagtagctgggattacaggtgcccgccaccacacccggctaatttttgtatttttagtagagacagggtttcaccatgttggccaggatggtctcaaactgctgacctcaagtgatccacgtgcctgggcctcccaaagagctgggattacaggcgtgaagccactgtgcctggccaagaatcaacttactgataaacacaacaagacagctgaatcgcaaataatagtatgctgagggaaagaagcttttaacgaatgcctacctgcctgccctccttccttttcttcttttatgtttttaacctggcttaattttcttggtttcattattttaagcaatttttgcagtgttgaaaaatttgcaagtaagttttcagaaacagttaacttcaaaatcctacacatgctatacatgaagacagtaaaaacatggatggaaagaaataatcagtttatttacattttctgtttatatgataagtagtaatttagctgaggttgacaattcatttaaatgagataaaagtcatttacattgtctctgtggctgttttcacgatacaaagggatgcaaaggtagggtgttactgagcaaacaatgggcttgctgcctaatgtacatggaggccaagaccacggcactggcttttgaggaaaaaaaagcttcattgcaagtggactggcaaggagacaggaggaagtgctccaatatatcacccccagctggcgtttgggtcgggttttataagcatagggtaatgaggtgtgatctgattgaattctgcaatgagatgatgccaggaggcatgatctgattcgattccacaatgggctgatgccagagctcaatttgattggatcctggatccttccatactgcgtctgcttcttaattcagtccctgctccttggtcttctccttggtctgggcacttctgttccccttgtggttgcatacttggttcatctgggcatgctcagtttacatgaccttcagcctgagggctcagaccaactcataactttgttggattaaatttagccagatttgtctggcgctgttgcaggtagagcagttgtgacagagactatgttgccctcaaagctgaacatatttacagtggtgcacccttatccacaggggattccttccaagatcctcagtggacacctgaaatcttcagtagtacaggacaccatacatattgtgtttcctttacatatatatttataataaagtttataaattaggcacggtaagagattaacaacaatagctactaataacatagaacaattctaacaataagccagcatcactattcttgtgctttggtgccattattaagtaaaatgagggctccttaaacacagcactgtgatacctcaacagtcaatctgataactcagaaggctactaagtgactaacgggcaggtagcgtataaggcatggatatgctagacaaagtggtgattcatgttctaggagggacactactcaaaacagcatataatctaaacttatatactatttatttctagaattttccatttaatattttcagaccacagttgaccacatttaactgaaaccacagaaagtgaaaccatggatgggggaactactctataccatatcatctgtcaccttacagaaactgttcactgatcccttttgtagactaaagagtcataaagatttctcactatgtgagatagaataatttttaaaagcgtaagtttcagtttacacttttaagttccaagttccctctatgactgatcatctgactttgcatgagtcacacaagctgagtccagctgtccccagccactgagatgcagatactaacaagcacctctactcagttcccaatctgtcaagtgtgcagtgagcatctaaggtcaagaatacatttcaatgatcacaacagctggtgctgagaataccatcaaaatataaataatggccttgacaatgtaactgagaagactagtatatttgaaacatgggaggcaaactcaagacagaatataaatacatttaattactaagtcacgtagtaagttttggtatatccatatagtggaatattttagcaggcattaaaaatgatatttttcggccaggcacagtggctcacgcctgtaatcccagcacttcaggaggccgaggtgggcggatcacgaggtcaggagattgagaccatcctggctaatacggtgaaaccctggctctactaaaaatacaaaaaattagccgggcatggtggtggacgcctgtagtcccagctactcgggaggctgaggcaggagaatggcatgaacccaggaggtggagcttgcagtaagccaagatggcgccactacactccagcctgggcgacagagccagactccatctcaaaaaaaaaaaaaagatatttttcaaagaaatacgtttatggtggtttggttttaattgagatacataaatactgcttcaatttctgtaatggctgtgagatgttcctgttttaactcccttcttgggaaactatttctgtttgcagatgacataatcctatatctagaaaatgccatcatctcagcccaaaagcttcttaagctgacaagcaacttcagcgaagtctcaggatacaaaatcgatgtgcaaaaattactagcattcctatacaccaacaacaggcaagccaagagccaaatcacgaatgaactcccattcacaattgccacaaaagaataaaatacctaggaatacagctaatcagggagctgaaagacctctacaaagagaactacaaaacattgctcaaagaaatcagagatgacaccaaaaaatgaaaaaacatttcatgcccatggataagaaaaaaacaatatcatgaaaatggccatactgtctaaaacaatttatagattcaatgttattcccattaaactatcattgatattcttcacagaattaaaaaaaactattttaaaattcacatagaaccaaaaaaaaaaaaaaaacgcccagatagccacaacaatcctgagcgaaaaacacaaagctggaggcatcacactacctgacttcaaactatactataaggctacagtaaccaaaacagcatggtactggtacaagaacagacacatagaccaagggaacagaaacgataacccagaactaagaccacagacttatagccatctaatcttcaacaaacctgacaaaaacaagcaatggggaaaggattccctatttaataaatggtgttgggagaactctggctagccatatgcagaaaatggaccatatagaaaaatcaacacaagatgtgttaaagacttaaatgtataacccaaaattataaaaaacctaaaagaaaacctagtcaataccattcaggacacaggtatgggcaaatatttcatgatgaagatgccaaaagcaattgcaacaaaagcaaaaattgacaaatgggatctaattaaactaaagagcttctgtacagcaaaagaaactgtcatcagagtgaacagacaagctacagaatgggagaaaaattttgcaatctatccatctgacaaaggtctaatatccagcatctacagggaacttaaacaaatttacaataaaaaaacaaacaaccccattaaaatgtggacattcttttcactctaggaatctctgatttgtctctggcactttcaagaatttgtatttttctttgtcatctgatgattcattaaaatgtatcaaggtgttggagattttttttttcatactgcttgtagatttttttgctttccttcctaaattcatgttcttagcctattgtgactcggctatgtgcaagaagtctggctcagccttcccaacattttatgtgtccaaggcctacttttactttcccctgagtagttgttaataccccaaactctgggtaacccaggtcagtttctgttccccaggcaactctagctcctgtactgcttttatctatttctggattgccatcagggcttccttgagagcttcacatttacttaaaagtagacttgatataatgttctgatattttgtagagctacaaggctttttaggaaacccagtttggccaattgacagaaatggaagtccaactttggtgggaaaactattattgtcaatcactttatatagaatgaaacagtggtgcagagacatgactttgaattatgcaaggtcaaagtgccaacatacttcagatgtagaacttaaagtcaacaaatctgaaaccaacgttaatgtgttcctcaatacttcagtgaatacaattacggatagcaaggtgagtaacctaaagcaaaaacaagggactactttactccttgtgtttcgtcctattccataacatagtttgtgttcttggaactataaacttcatctttttaactacttgccacatggtaaaactgacaatcatgaaatatgtcatgttatcctgtgacttagaatgtctggtggggcatcactccactcttctggagagaacatgtatgacagtttgaaacattcaaaatgtgctgttctttgcagtcaggaaagaacttcagggcaggacagaaagaaatcagtcacaacatttcagatattggtgttagaaggagttatttagggagttatttagagataagacatacttcctggctctgttgaaatcacattgtgtaagaagctgcctatttcattaatacataaagccagccttcctttacaagtagaggctacattatccctgattatgctttatttttaaaacgtgaacttgaggagagagactcaggcctgtatcatacactttccttagtttttgttttgtcagaagcatattattaacaagtagtctctttcaaaaagacaagatacaaacgagtagaaaaaaatccattctcttatctcatgatggttagattatttaagagttgaagtgattgctatgtcatttgcataaattcaaggacttttatttatttatttatttatttatttattcattcatttttgagatggagtctcgctctgtcacctaggctggagtgcggtggcgcgatctcggctcactgcaagctctgcctaccgggctcatgccattctcctgcctcagcctcctgagtagcgggactacaggtgcccaccaccacacctggccaattttttgtattttcagtagagacggagtttcatcctgttagccaggatggtctcgatctcctgacctcgtgatccgctcacctcagcctcccaaagtgctgggattacaggcgtgagccaccgcgcttggccaaattcgaggacttttctctctcaattgcttacaattaaaaattttgtagtagcacatgctcacagatttggggctttcagaaatgtcttttcaaactaaaaacttttaaaataaataatattgcagatatttaaaataataatatttctagattgcagaggaaatacaaactcccaattaatcataccaaatatattctatgttctttaacttctggtagaaaaaaaatcagatttatactttatatcttcctgtattttagaaaatagcagacaatgagagaagatcattctctaatgagatatttgggatccaacacggaataaatgtctgtatcttaattttaaatttttactatataattattgatatcttttcctaaaaggggaaatcccttactctaattttgagattgatatttagaataattgctaaactaaatagtagacttgaaaaagctttgctcataaaattcttacagatttattttattttacagaagtggtaatggtaattaacaaaaattcttaagtgtaataaattcattttggtagattttggtatgtaaatgagaaaacagtcttctaactataacaaattatttagcttagtctgtcatataaaattcagtgaaaaactaaaaaaaagtaacaaaaaactgagcctattcaaattatatgtaaagtttgtgcacagtatataaaactaagttaagtaggcttacaaaataacacttcatatagtattttggggaaactctttctccaagaggagaaaaaatagccaaataggaaagagagtgcaaggtttttaatcaagtgtgtctcttcccttggcttgtgtgggaagattgtagatgggattactaggatcagatttagaacactgatctgatgtcaatgacctaagtcagcatagccagcaaagtaatatttccagataaagagagaaaaaaaattctcctagataagaaaaaaacaacagggtgctctcaaaaccagcactgtaatcaccactgagctaattagtaggacatttaaggccaaggcaccatggaaaggccagaaagagacaaaagtcaataaaaatggtcactgacgacagagtcacagtgcctggctgacagacggtgctgaaaatccctgagagatgaggatgacttcagataagagcggtccagggaagatactcagtcattgacaaagcacaatgggaagggtcagtaaaaagatcaataacagaaggaaacagctgccacattcatcattcttaacgtcaaggttgacattggataaatggagttggccttttttttctttttttttttttacaatagtttagtgcagaaacctctaaaaggagcttgtacatgaagaactgaagtgagaagcctagccatttgtataccttttagtaatagagactgaatattaaaacagacagtggccaaaccacgtacgacaatggaactctgacccacaaccactgcagcaaccagcttgggaaggcaaaccacaatctctgcagcagccagttcaggaatgcaagccacaaattcagtagcaatttgccgaaaacaatcagaggttggtcaatgactgccaacttctctaagattgcccctgcttctagtttagtactaattaaagaaagccaaatactctctccaaacctatcccatcagatgccttgcttctctttagcctacctgcgcctctccatgcccatagcctcctaccccaaagccttgccccttttcactataaagctttcccattctcccagcctgagtctctgtcaaacataaatgatagtgactgcctccctttctctagcaagcaagaaataaatagcttctgttctcattaagctgtctcctttatttctgtaattttctgtttttttttaattttttaatttttttgagactgaatcttgccctgtcgcccagactggagtgcagcagcacgatatgggctcactgcaatctctgcctcccaggttcaagagattctcctgcctcagcctcccaagtagctgaaactacaggcatgtgctaccacacctgtctaatttttgtattttttgtagagacagggtttcaccatgttggccaggctggtctcgaactcctgacctcaggtgatccacctgcctcagcctcccaaagtgctgggtttataggcatgagccaccatgcctggtctgtatttctgtaattttcctagaagctccactgagacacattcttaactgctcatcactatggactttggaacctgatcaagtgcgctatctatggaggcctcttgtgccttgcttcttgaggcctgtcaagtctgtgttgacacagtgtctgtgagagaacagagttgggcttcaactctgttctctttgtattgagatccttggttattgactatcagcttggtactcagcttttgctaccaattcccatttgtttggcacccttggaaaaatactgccatttcttttcattcctttttgttctcttttgtgcttctgttttatgagatatgtctaaagtgttgtctgttatcagaaggagaatcagtgcagaacacaggctttgctcctctaagagtgtctcagcttgctccacaactgatgagctgcaattcttaccaaaccagcatccatctggacaaactttcctaaactttcctgtcagtcaccaataaaatgggataaggttcttcatcttttttttttttttttttttttttggccctgagaggttggatttgatgcagagggaatattctggttttccatttgcctgtgggcacaagttgtcaagtctgcatttggaggttgccaactatcaggttgggggcctaagacataaagtgcacaaatattactttcaactgaccattgccagctcccatggaattttctgagtgtaaatcctcttttcctttttttcctccagaaaaacctcccatttcttatacgtacccttgctacgatcctagcacttgcacccatctctataccaaggataatttaggccttcagtggctaatctggagaacattggacttgaacaaaattgttcatttgaaaaacaccttagaaaagagagaatatttctcaggggcaatgggcagcagtttttgattggtacacaagttttcaaatgaaattctgattcagacattactccgctaaaatattttttggccagagctaatgaacagtatgacaaacttaacaacaaactaactcatttgcccagcaaatcttcccccggcttctcctccagttgacttcagctctgcaactcttcctcatcccccgatcctcctttcacacctcattgactcctccctcttcttccagaccccctaccttctcccagtgactctcctaagatcccggaatgtcatttacctctaaagttccatctcttcaatgacccaaatacgcaagcagcagtagaatttaaaccttgaacacgagctgaattaaaagctatgactaagcatttcccaaaggagttcagaattctaaattcttttagttgtacacaactcagggttacctgaactatatcaacttgtatttatgtttgtagatcctcagacattaaatcctgatggcaaaagccagttggattcaccaggacagagatctacagcatctttctttccacaataagcctgagggccaaaaagaggctcaaaaagtagggcaatgtatcctaaaagccttacttgaaacatttctagtaaaaataaaatggaccacaatttaatcatgtaaataaagaaaagaagaaattataggagattttcagaataaactagaaaacccctttcaacaacatttgagtgttaaagaagtgtaagtgtaataatggctcttttacctactttgttaatggaattaaacctgaaattggagacaataattagatcaaaattagaatgggaaatagccactttacctgaacttcaacacctggctgacatttttgcagagccctaggacaataacaagacaggatccagaataaccttacggccctgcagatcaaacagttgagtggacgacccatagaagaggacacctgcagatattgaaaacagaagggacacctgaaaaatgattttccagtaaaaataagaccaaaagaccccttaatttagatcaatgaaggtacccaatatcctgatttaaaatttaacattcaaggtgaattaaccataaatataggtggccaacctcagcaattcctggcaatatgggcgctactctttcttttctttctttctttttttgttttgagacagagtcttactctgtcactgaggctgcagtgcattggcacaatctcggttcactgcaaccgcttcctgggttcaagcgattctcctgcctcagcctcctgagtaactgggactacaggcatgcatcatgataccctgcttttttttttttttttttttttttgtatttttagtagagatggggttttgccatgttggtcaggctgctctagaactcctgacctcaggtgatctgcctgccttggccccccaaagtgctgggattacaggtgtgagccaccatgcccagccaggcactaactctttctacattaaaccctggcaattttgctcaacattttcctcataggaagcaagtagcaggtatctcaaataacccacagattccttctatctcctactgtaactacaacctttgggtacttgacttaaaaacatttctccctgctctattataacactcttgcaaatttaatggggagtaacttaattttcaaatagaattataatagtaagtgcaccagctgggcatggtggctcacgcctgtaatcctagcactttgggaggctgaggtgggtggaccacttgagtacaggagttcaagaccagcctggataacacggtgaaaccctgcctctactaaaaaaaaaaaaaaaaaaaagaaatacgaaaattagctggtgtggtggcacatgcttgtaatcccagctacttgggaggctaaaatgggaggatcacctgaacccgggatgcagaggttgcagtgagccaagatcacacctctgcactccagcccgggtaacagagcaacactctgtctcagaaaaacaataaatgcacagcagagtctcctgagggttcctctatatgtcgtctctggatatacgtttgtctccttcattatatttgacatacgctccagataaagacctcaacactctacctaacactctacaaactaaaaaaatccatttatatgggaaattactggagcagaacctagtcaagttcagaagtatcctagtaaaccatggtcaaacttccctgatattccttgaaaaaccagaagcaaaggaaggcttcaaaactgtagttgacgaccttataaccaaagactttctcatacgctgcaatagcccatacaccacacttgttctgctggtacacttttttcatgacctcaggaaagatcaacaaaattgttttgctttgcttcctagtagtacctatcctgtcatcaattctgcccaaaaccacttgcttcaccatattgaatctttactgtgcatttttcagtgtgcttccaaaccagaacaggcaacgactttgccttcatctggagaggacaacaaatatacccggatagtcataccccaggggctcactaaagccccctcttactttccacaagtcctcaatcaagacttaaagatctaaatttcacttgtgattcggttttgatgcaatatatgcaggatcagatgatctccactgctttcttcagagaacgaggaagctggtgagaaggtgagagcaagtaaatacttgctctcagccatagcagaaaaagaacataatgtttcaaaagataaattataattttgtcaaaagacaggctagtatttagggcataagttatcttaagagggtgaaattattttgtctctattggtaggcagaacactatcgaaacttcacctcgatgcctcgcaaaatgacaattgagaggatttctagatttaactggatattgtagacaatggctgcgaaatttttctgagcttgcaatctctttttatgaattggccgagtccttagtgagaaactgtcttttgtgggggcccaaatataaattctgtaactcaagaaggctcttcagtagcctcttcctttggtagttaggcactccctttcataattaggcacccctgactacaatatgccattttgtctaattgtgcgtggacaacttgtacaagcttttttgtttttaactcaatgtcatggaaaccatcaaaaattcatcattttccatagccttacccttgacccagctgcaaaggcttatagcccttgtcttaaggcaacagcttccactgcaacatttgttgatgcttcttttaaactatttctaggctccccacctcacatcatgattccctggccagtgtagacataaccactgacaaagagcatgcaatactttccaaccagctgatcaacttcttatgagagttttactccctctctctcgctttactattcactgatgcaattccttaaactgccactcttctccccctgccagaagaagggaacctcatgatggttataagtcagttaggggagtttctgtacctcactcagattgatgagagactgactcttattgtgaactctgattcaatgttattcattgatggatcatacctcaaaactgatattgaaaattatcactaatttaagctctactttagaatatattttctatctgaggtaaaatcaacccatataatggaatttattacacttactagagcttgtcaattagctgaagaccatgtagtaaacatagagcaggtatgcttttagagtactacatgaatttgggatgctttggggaaaaaaagaaattcatcatctctgctggaaaccccatgaaaatgaataagttaaggcactctactttctagagttggctattttaaggttgaggcccatacaaagaaagaaggtaatagaaaaactaaagaaaaaattctaacagaactttatgccaaaaaaaaaagccttaactaaagttaatgtttttgtttgtttgtttggttggttggtttttgttttttgagatggattcttgctctgtcgcccaggctggagtgcagtggcgccatctcagctcactacaagttccgcctcctgggttcacgccattctcctgcctcagcctcctgagtagctgggactacatgcgcccgctgccacgcctggcctttttttttttttttttttttttagtagagatggggtttcactgtgttagccaggatggtctccatctcctgacctcgtgatccgcctgcctcagcctcccaaagtgctgggattacaagcgtgagccaccgagcccggcctaaagttattgtcttctgtaaatcttcaaaggagaagttcctaaggattcagataggccattataaaatatcagtgggtcaaccccagtttccaaacggaagtctggaaattccacctcagactggagcttccaaatgtggccacctttgattattcaggcagtctacctgggggacttactgactcactgtgtgaataatcagagtgagaattgtacaaatagaaaaaaactgtaagaaaaccatcaccaatagttttatcaccaataactctggcagaagttaatgacattgtctcttccctatacgaaatataaatcagcctcaattcattggtacaagtaataataaccacatttctctagatttcttgttggctactcatggtagctctgtgttattgctaatacttctcactatatttgaatcaacgaaacaggcaaagtaaaacaggctctacatctcacatttccttatggaaaaaagataattgccattctaaggcagatcttcaaggtctgtggcctatatgttctcttggtctgggttggaaaattagaatttctgcttctgtaacattttatagggactagtgattatttttgtttttgaaacccgacctttaagccaaagacagcctgacccctgaaaacccaactgccagttctaggtagagtccacaaccggagtgagaacatcctctatgccttttaaccaataaatggtgctttttccaagacctcccccggcccaatcagcatgcactcccccattctgagcccttaaaaatcctatactcagccacacagatggctgccggctttcaggccccctttcacacagaagtctacccacttcaggtcccctcttgtgttgagagcttttctgccgctcaataaaattcttctctgcctttctcactctctgctgtccacacaccttattcttgttggttgtgggaactccccaagctgcgggtggcagtaacaaaggagatgtaaggcacccctgttcactgggctgcaggcagcaggaaccagagagaactgtaacatttccagggggctcagacctcaggactccccaagcaaaagctgtaacaccctttggggctttgcagttgctgtcatctccaagtattctggcgccaccacctccccttcatctcgataccagcgcccaatatggaagccaattgcagcatgcccagtccagctatgagctgagcacgcagccacactgaccacaggatctgggccagtaatgtgagccaagcgcagcctgctgggccaagtgggcagagcaacccggcaggcctgagcaagggccggaacagaagtcagtgcagccacagagatttccagctggtgaagcggcactgaaggaattctgtaacactgtaacctccctctcactcaccaagcaacaggggagaaaaagccgctgggcgccattccaccctgcacatggaactacaaagcgtgcaacactttggtcatacctgccatgatgcaggtccatcacatcctctgccaagtcttacattctactgggcagctgttctcaccagagatcattgccatactgtgtccggagttggttcctactggtgggttcatggtctcgctgacttcaagaataaagccacagaccttcgctgtgactgttacagctcttaaagatggcacagacccaaactgagcactagcaaggtttattgtgaagaggaaagcttccacagcatggaaaggggagcaggttgccactgctggctggggtggccagcttttattcccttattggcccctcccatattctgttcctgtcctatcagaatgcccttttttcaatcctccaggcaattggctacttttagaatctgctgactggtgcattttacagagtgctgattggtgctttatacaatcctcttgtaagacagggaagttccccaagtccccactggacccaggaagtccaactggcctcacctctcagtgctgacacaacaacaaaaagtcaagacctcacaatatagtttgcaatagagaccactcggcaatatcatagtggtgaagatgtgggtttctagctgcccctgaattggtcaatctctcgtaagtaagagaatgaccataatggggggctgagaggataaatattcaaatgagtagtggtcagatgatatgacaatagaattctgattcacaatctctgaagccaccagtccaggaagccaaaccgcatcattggcagtaattggtcccaagtggtcaggatatcattaatgactgttagcttccctattttgccttgtttccaacttagaaccaaccaaataaagcaaaatatgttccccaaaccaaccacataagatactctgcttctagttaacctacttccaacttccccttgccaactacatgcaatcagagcatacttgaagccttcccccatgctttccctcccgttttttgctcactctaaagctttcccactcccaaactttgaattaatcacctgttctcatgtgggtagtctacctttatttctacagtaaggtgcatgcaagccttttctagtcacatttaaaatggtgaaaagcagcatcataccagaaatatttgattttctactttttgattaggtaagcagagagggatgatttctgagtcttacaaagagtacatatcacttcagaaacatatgagttgtggaaagtgatgtctgcttttctctatattatacataaaacatagcaaatatcttactttaatgagctggtgtgtggggatatagagatgaccaagctgaaaggattgacaataagataacaactagaaactgaatccctgaagtgacatctctgtgcttgcagccttttctctgaatataaaatgcacatttttacacaacccctgtgaaatcttagcactttatatcacaagggtaagtaaaatgcacacgtttttaaaaatcaagtattttaaggtctccaaaatgacagatcttttccctctgtgagtcatatcatgatttaccttgaaagtattttaagaatattctacgacacaaagagactaaggttattcaaatgagtttgaagtccctttagtttctctttattctcaatgaattgcaaaggcaactgcagttccttaccctgcttccagctctctgctgaagttgaggtttgtgggggttcaatcaggccaattggaaaaatattaatgatagttatagtaatagccacaaactctcttggaaagcctgagagtttgcatagcttctgattgtctggctgaaggcagccagagtctctttgcaggagctagagagcttaaggcacaaatacaaaataatgtagagtagtttatctaactaacttgttttcctaagactaacctttgatgtaccctgggtgcttaattgctttctactcaggaagtccacaatgtcagttaccctctaatggtgttttcctatgacctttgtcaattaatctttactaaataaatgcaagtctcactgactgatcgaggagttgcaactgtttacagtactctccagggagtctgtaggtggctcagacactcagctggactggcaaagcagaatatctgtgtgtcagtgtacttcattcatccatcgctgggtcagggtctgcaggttggaccctagcagaggttcctcaaaggattccacattcttggtcaccaaagctgttgtggttttcttcaccatggaagtagataagtagcaggcctttgccctaatagttggtcaagtccctgcaggcgcatggggaccactgttctggcaaatgctggttggggagaacatacagattttaatcacttttaaaaatagactcagggggtacaagtgcagttttgttacatggatatattgtgtgctggtgaaacctcagcgtttagtgtacccatcacccaaatagtgtacagtgtacctttcaggtaatttctcatccctcacttccctctcacccttccagtgtctactggagtctccaaaatctccaatgagtcttcaatgtctattccacttttcatgtccatgggtacatattacttatctctcacttataagtgagaacatgcagtctttgaatttctgtttctgagttatatcacttaagataatggcctccagttccatccatattgctgcaaaaagtataatttcattcctttttatggctgagaagtattccatacttcccaaacagaaatgttgtacttgtgataacatccagccacttcttttatcttatttggaattcaaagggggcaaatttcttcttattattaagcagtatataaagcaaccaagaataatcttcagaccaaagaagactattcatgtccatgaggatggcacggagagagactggcataagataaactgtgaaaggcagaggaatggaagggtttagggcttcataggtcaggataagcaacttgaattttattctgaatgcaatgggcaatcattgaagtgttttaggcagtggagtgactttttcttttcaagttttgagtgattgtccatcttcaacctgtaatccctcctatttaccataattcttcctttttaccagaatggttacagagccaagtcaagggaggggttggtaccattagaatataaataacattttctgaatagacatagggcttttcttgcaacactaagttaccattacacttctagataaaacaaatgtgatgatttgtacatgtgcatagaatctaggatgaattgtactttgagttctagactcaaattggggtggtagaagtggaatggagccaggaaatagttaaattctagtctctggggttccattaaggagaacagatcattcttatcctctttggttataaagaccctaaactgtcttttccatgcttggaatgggtaattttaaattttaaatacatagaataagcaggccttcaggaatttattacttcacacagtccatatgcagccctcttattttgtgccttagcccctgtggacacctcttcccaaagcaccagattttcctgctgttgtaagtgtgtacaggacccaaggctaaagtaccttactgacacagcaggctgctgacctcacccctcatcttcaaagcattttcaagttggagcatatttgtgaaataaatattatctttcttccttctaattacaaaattaataaatgttactttgtaaaaataataatttaaaaatcactcctattttcatcattcccaaataacagctaaaattttagtgccatcttttttttaatctttcttgtgcactcatttacagtgtgaggtacagggaaatttaaggagcaaagaagaagtttaattttttaaaatcattttgaaattactagaagtattaaatccttagaggttaagttcatttacattggaaaaactctctttttctctggcatgaaccacttggacagtccctctcatgataacaggtataaggcaagtgcccaacgcatggttcaggggatggttgtaactatgtttgtcttatcaatggtctgataagtgaggttgctcctgcttctagaagtatctatttttcttttgcaaatttatagagatataaaagagccatttgtgcagaagggaagtggcatccagaccatttctctttgagcttcagtgccatttagaacatgtttgataaactagggtgtctcagactcacaagtattgggagaaaagagcaacagtggcccattaaaggaaactcaatataagtgaagtgaggtactggctgggactgaacacttgggtcactgctgatagggagaatgtgtggcagatgctgacttctgtatcaggattatcagtggtgtttgaagcctgttgaagtggattgtggtgaatgctcgttcagtcacaccactcacccgttagttaaaggccataagaaggcagaaaggcaggttcatcctgagtcagggtttgtgagagtgatgccatgcgatgggcagagaggctagggaagcagctatcaaacgataatgtacttcagaggcgcatattccatttgcagatttcaagcttcattcattccagattgaatggggcctaggaatatgcattttagcaagtacccctggtaattcagaggcagtagtttcatggaccacacttggagaaacacagttttgactaatgatagaagagaggaaatggtaaataatggacgatattcttcctaagcttgataagatgagaaacgaatacagcaggagctaatagatggggagaaagtcaggtggaatggatggaatgaatgcggttactgagtatcaggatgaggggaatttcatcctgaggagaatatgagtaagaagcattttcaagcaaaataaaaatcagatatgacttttcctactgaaaagtctgaagttaaaataattaaaactgctgtttgttcagaaatggacaaatcaacaatgaaatgaggggtctcagaatatagtgtgcacgtatgaacataatgaaaggtaaaggtgacattataaatgtgtagggtcacagaatatgaacaaagtgacataataacatacagaaaggacattttgtcttttgtgtcacactgtgtctcatcccccacaggaagtaggagcacatgtccaatggcatttaattagtagacacttttgaaaactgagagaatatacaaccacccaacagtcagaatacccctccctcttctacatagagaggcgggagagactgataccaggtacctccaggtgattgaagagctaatatttagtgagcaatgagtgtatgattttgaaatagacatcttgtcacttttcagtgttttctacagatagaatagaaccaagagaaatgaagaagtgtggtggtgagggaacaggcttagatacagaatgccaaatatctcactgatggcttaggctacccgcaaattggatacaaatgctaaaatcacatccctgtggtagtgagagagagcaataatcttaggtttatggtaaggaagagatttctatgggaattctatggaggggttactcaacgttttactggtgttcaacttcagtatattgcctaacccatttaaagacttgtctttgtgtagtatttgatagattaatatatattttaatacatttttctacccaattttccttaataaattaaaaaactgtggttcagagtgataaagggtattgaagttggtaccattagaatataaataacacttttctggccaggctcagtggcttacaccagcgggcggatcacctgaggttaggagttcaagaccagcctggccaacatggtgaaacccggtctctgctaaaaatacatatatgtatatgtagctgggcgtggtggtgggcgcctgtaatcccagccactcgggaggctgaggcaggagaatcgcttgaacccgggagacagaggttgcagtgagccaagatcgcgctactgcactccagcctgggtgacagagtaacactctgaaaaaaaaaaaaaaaaaaaaaaaaaaatatatatatatatatatgtataaacatttttctgaatagacatactgatatggtttggctctctgtccccatccaaatctcatctcgaattgtaatccccacacgtccgaggagggacctggtggggggtggtcggatcacagggacagtttccccgatgctgtgctggtgctggtgagtgagttctcatgagatctgatggtttttttgtaagaggaagtttcgcctgttttctttttcctgctgccttgtgaagaagatacttgcttctcctttgccttccgccatgattgtaagtttcctgagccctccccagccacgtggaactgtgtcaattaaacctgtttcctgagaggtgctccagcctccgcgcggtcagcagtcagcgccctagtgtccggcctgccgcatgccctgcaggtagcgcccccgcctgcggcccagagtgcactcgcgcctgcgccatctcccggaaaaatttcgcgccacgcagagatgacagccaaggagatgaaggcgaccgagagtgcggcgcagccggcgccgctgcccaagaaggaagtggacgtcagccccaaacaggatgaaggagtgctgaaggtcatcaagagagagggcacaggtacagagatgcccatgactggggacctagtctttgtccactacactggctggctgttagagggcacaaagtttgactccagcgtggatcgcaaggacaaattctcctttgacctgggaaaaggggaggtcatcaaggcttggaacattgccgtagcaaccatgaaggtgggggaggtgggccacatcacctgcaaaccaggatatgcctagagttcagcagacagtcctccaacgatccccccataacgccacgcttgtgtttgaggtggaattgtttaaggaagaagatctgacggaagaggaagatgggggaatcatccgcagaatagggactcgcggtgaaggctatgtcaagcccgatgagggcgctatggtggaggttgcgctggaagggtgctgcaaggaccagccctttgaccaacgggcgctccgctttgaggttagcgagggggagaacctggatctgccttatgatctggagagggccattcagcacttggagaaaggagaacattccactgtgtacctcaagcccagctatgcttttggcagtgttgggaaggaaaagttccaaatcccaccaaatgccgagctgaaatatgaattacatctcaagagttttgaaaaggccaaggaatcttgggagatgatttcagaagagaagctggaacagaacaccatagtgaaagagcagggcagtgtgtacttcaaggaaggcaaatacaagcaagctttactacagtgtaagaagattgtgtcctggctggaatatgagtctagtttttccaatgaggaagcacagaaggcacaggcccttcgactggcctctcacctcgacctggccatgtgtcagctgaaactacaggccttctctgctgccattgaaagttgtaacaatgccctagaactgggcagcaacaacgagaagggccccttccgccggggagaggcccacctggcggtgaatgactttgaactggcatgggctgacttccagaaggtcctgcagctctaccccaacgacaaagccgccagggcccagctggctgtgggtcagcagcggatccacaggcagcttgcccgggagaagttctatgccaaaatgtttgagaggctggctgaggaggagaacaaggccaaggcagaggcttgctcaggagaccatcccactgacacagagatgaaggcggagtgcaagagcaacacggcgggagccagtctcaggtggagacagaagcatagcgcctctcaccagccctactcctgaggctgcctgccccccagcctccccactccaccctgttagttttgtaaaaactgaagaattttgagtgaaaacaaaacaaaacaaaaaactcctctttcatttataaattacacagtctcaggtatttctttatagtagtgtgaaaattgaataaaacacataatttcaccttgtaaggtgaatcctccttggttctcatgtaaccaatgttttaacactcttctttaaaagggcttttcttaatgttggaaaaatttcccaaaacaaaaagtgcaatagggacatattaaatttagcaaccaaagtgaacaatgtctattttgtttctagttccctctagtcactgtgctccttggtcactcccacaccctaaattccgaaacaagtgggcactcaaatcagtaagaccacagtggcactcaaataaaaagccctcccagcatccctcttatttcccctaggagttgttttttttttttttttttttgagacggagtctcgctctgttgcccaggccggactgcggactgcagtggcgcaatctcggctcactgcaagctccgcttcccgggttcacgccattctcctgcctcagcctccccagtagctgggactacaggcgcccgccaccgcgcccggctaatttttttgtatttttagtagagacggggtttcaccttgttagccaggatggtctcgatctcctgacctcatgatccacccacctcggcctcccaaagtgctgggattacaggcgtgagccaccgcgcccggcctattttatgaaactttaagcccatcttctttctttttttttttttttttgagacggagtcttgctctatcgcccagcctggagtgcagtggcaagatctcggctcactgcaagctccgcctcccgggttcatgccattctcctgcctcagcctcccgagtagctgggactacaggcacccgccaccacgcccggctaatttttttgtgtttttagtagacacggggtttcaccatgttagtcaggatggtctcgatctcctgacctcgtgatctgcctgcctaggcctcccaaagtgctgggattacaggcttgagccactgtgctcagccccttcttatttcttaattaatttatttattgaggagccatgtagggagacctagtgtacaagcttcctgcatttagaatcagttggacttaatttctctctaatgcttgttttcttatctgtgatttggtggtcataataatacttatataagagggtatgattattccgaggacttatggaagtaaagtgcttaaaatgcttatcacagagcctgacacatagtagcctctaaaaatttgttaccaggcactgcgttggtaacataaaaaaaaattctcctgttttcaagtatactactgtttcacaagggagagaaaaaaacataaaaataaaattaaaagttaattttaattaactttaattaaaagtttattctaaagatatagtaggtaaatttttatctgaagaattaaaaatgagcaggatactatgattcattttaaattaatttttgtgcatggtgaagtgcaggtcaagatacatgtttttccccattgtattagtcagggttctccaggaaaagagaaccagcagaacagcagaatgtctatctgtccgtctatgtatctatctacctatctatatcaagagatttattttttaaaattggcttacacaattgtaagggcttggttaatccaaaatctacaggttaggccagcaggctcgagacccagggaagagttgcagtttgactccaaaggcagtctactagcagaattcctccttgctcaggaagtgtcagtctttgctctattattattattattattttttgagacagggtcttgctctgtcgcccaggctggagtgcagtggcatctcagctcactgcaagctccacctcccaggttcacaccattcttctgcctcagcctcctgagtagctgggacaacaggcgcctgccaccacgcccggctaattttttgtatttttagtagagatggggtttcaccgtgttagccaggatggtctctatctcctggcctcttgatctgcccacctcagcctcccaaagtgctgggattacaggcgtgagccaccgtgcccggccagtctttgctctattaagtctttcaactgattggagaaggcccttccacactatggagggtaatgtgcaaaccctaagtccactgatttatgtattgttcttatccaaacgaaaaaatcttgacagaaacattcagaataatgtttgaccaaatatctgggcactgtggcccagccaagtttaaagacaaaattacccaccacacctacagatatctaactgacctagtaaattttatggaaaagactatctttttgtccgttgaatggaagtggcatcttcaggaatatgtatctaaaatatctattctgccttaattatagtgtttatagtaaaataattctcatatgtaatacatatgagaatatgtaaataaattatgtaatacataaatataaatatcatttatagtaagctaagtcaaagtttaatttttagcaacatttattcaggatggatcataggccacaatgtggaagcttggacagtaaaaacaatacaaattctataacaaaaaagtacaaaatatcttccatgaccttgagataggcaaagatttcttaaacaggaccaaaaagacaccaaatatttttaaagtttattaaattgaacttctataaattaatgacttctattcatcaaataatataattaagttagttaatcttgatgtcatcccatttgtttatttttgcttttgttccctatgctttcagggttatatccaaaaaattgctgatcaaacccatatcttggagcattttctctgttttcatgtaatagttttccagtttcaagtcttatatttaagtctttcatcaatttagagttaatttttgtatatggtatgatataaggatctcatttcattcttctacatgcggatactcagtttttcccacagcatttattgagaaggctgtgctttccccactgtgtgttctaggaacctttgtcaaaaatcaaatggctgggtttatttctgggctttctatcctgttccattggtcaatgtgtctgtttttataggagtacctatgtggttttaattaatatcactttataacatgttctgaaatcagggagtataatgcctccagcttcgttctttttgctaaatattgttttggctattcagcatcatttgtgtcctcaagtcaatactctaagttcctactcaagaaataagaaagaagaacaaagtaaattcaaaacaaggaaaatgagggaaataaaaataagagcacagctaatatcaaaaaatcaatcactttcctatacatcagcaataaacaagtggaatttgaaattaaaaacagaatatcatttacattagcacccctagaaattaaaaacataggtatacatctaccaaatttgtataagatctatatgaggaaagctataaagctgaggaaagaaatcaaagaactaaatacatggagagctattccatatacatggatagagagactcaatgttgtcaagatgtctttctaacttgatttgtggatccagtgcaatgccattcattacaacagcaaattattttatgcaatctaaaatgtacatagagagacaaaatatccaggtagcagagcgtagaataatgtttgccaggggttgggggtaggggaaattgggagatgttgagtaaagggtccaatttcagttatgcaagagaaataagtcctggagatctaatgtatagcatggtgactattgttaataatactgtattgtatacttggaatttgctaagagaatagatcctaagagttctcatacaataaaaaaggaaggtaaatatgtgaggtgatggatatgctaattagcttgattatggtagtcatttcactatgtacatgtttataaaaataccacattgatgcaagcttttgggctggggatcagagttctggtgcaattctagactcttctcaagaagaatctgaatacactcttgtggggatggtacaaccagcctagttcctgtgacagtgttctttcccctgtagccagatgtgggttgggtagtgagaggttagtcaaggttagtcagctccagaaagtctgtctgtctccacaaaggggagtgacaaagagcgggagcctgaactcaagtgaagagcaatcatgagggcgacctcataaggaggacttctcaaacacggggccatctaagtttcacaatgaccgtaaaagaaagccatttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcgcgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggccagaaagccattgttatctccattttctgatgaagtagtctgagaaataatgagactttcctgaagaaaaccagtaaacagcaaagtcagcatttattcttttcactccacagacatttttatctaggtattgttcaaaggactaaatgtgtgtcagtcttcattagtcatggatttttattttaaaaagtgtggtcaaaaatactttattaagtgggtgatatttaaataaacccttgcatgaagtgaagaagcaagctctgtagatatttgtggaaagaatgtttcaggtggacagaacaattaaaaggactaaggctggagaaggcctggccagtttagggaacatcaaagatacaaggggtgagggtgaaagggaacgggtagaaagggagatggaagaaagttttttgtctttacctaacagtcatgggatgagcaactcagctttgcatgattatccgagtacaggtttctttcaactttttgctgttccatgccccagggtatggtccatatctgcctaataacagctgggtcatgtgcttgtaacagaaggggaaagagggcacattctagggcaagtagcttattttgtaatttgaagatgtcctatacggtcgattgtttccaaagatgactgcaacactccattctatcttacatgaccttttgcaatatgacttttccacttttccatcaagacatagaatctgtcttacctccccttaaatctggactaatcttatgagttgctttaaccaatatcatgtggtagaaatgacaatgtgcaactccaaagacaaaacttcaagaatccccacaccttccattttttatgtcttggaatgcagctgccatgctgatagaaagctaagctagactgacggaggagaacagagccccagagtcagccaatagtcagcacaactaccagccatatgatttaaaccataatggaagttctagccctggctgagctccataggagtgaaactgcaagtgtgagctcataagagaccatcaaatgagcctgactcttaaatatttggtgtaagcaagtgtgagaatggagtttccaccagatgagattaggaagtttacaggtaaacaaagttttgaatgcaaagatcaggagttcaggtttgaacattggtaagtttgagctatctctaagacatctaaaaagagtcaaataagccttttggaattttagtttgcagtttgggagagaggtgttggctagagagccacatttggaagtcagtggcatatggatggaactaatgccaaaagactgactgaaacaagaaaaaaaattaacaaggaggagtcgtaatcaattatatcagatgctgcagatagtgtgagtaatgtgagaattgagagttgaccactgattttagcaatgtgagatttgttggacactttgacaagagcagtgtaggggaagtgctgaaaaatctgattggactgtgtttacaagaataacagagaaaaatattttaaaagagtgtggataactccttcaaggaattgtgttgcaaaagagaatagaaatgggacaggagctggcagagaaagtaaagccaagaaaagtttctttttgtttgtgttctattgttgtcatgcccttaaggatagggaatatagcatgactggatgttaatagaattttccaaggaaaaatccaaaggccagaggtgagctaatcttgcgacttctatttttgaataggtgaagtatgagcttcgtatatgagtaagggtagttagtctaagttaaaaggtgagaaggcagactctgtgggtgtaggtactggtgggtaagtgtctttgttcattttgtgctgctgtgacagatgaccacagattgcgtgattaattttttcacaggtataaaagctgtgaagcccgaaatcaagatgccagaatttgatatctggtgaggcccttcttgctgcctgtgcacatgacagaaggcagaagggcaagagagccaaatgctgcatttagcctcttttttaagggctttgctgcagtttgaatgtgtcctcccaaaaattatgtgttagaaacttaattatcattaaaatagtattaagaggtgattacactatgagggctctgccttcataaatggattaatgctgctattgtgggaatgggctccctataaaaggacctatttggcctgcttttttctctctcaccccttttttatgcccttcacgatgaaaggacacacatgaaggccctaggcaggagtcagccccttgatcttggactttccagctccagaatagtgagccaataaatttctgtttattataaattacccagtctgtggtattctgtgtaacagcataaaatggactaagacagtccttaatcctattcatggaggaggaatcctcatggcctaattcctcttaaaggcctcacctctcaatatgatcacattcttcattaagtttcaacatattaattttggcagaaatacattcaaatcatagcattcttctctggccactcaaaattcatatccttctcatgtgcaaaatacattattaattccatcccaatagccccaaaagttttcattcattccaacaacaactcaaaagtctaaagtccagaggtttatgtaaatcaggtatgagtgagactcaaggaacaattcatcctgaagcaaatttccctccagcaatgaggctgcaaagtcgaataagttattagcttccaaaaacacaatggtggtataggtgtgggatagacattcccatcctgaaaggcagaaattggctaaaagaaaggggtaacaagttctgagtaaatccaaaacccaaaagggcaaacaacattagatcttaaggcttgagaataattttatttgactcatgttttaccttcaaggcagactggggcaggggttggatccccaaggctccaaaggccacaaccccatagctttgctgggcacagcccacaccacagccctcatgggttggagtctcctgcctgcagctctttcacgctggcattgcatgctggtgactctaaaatgtggaggtctccagcatggccctacccccatagttccactagattttgtgttagtgagtactctctgaggtggccccactcacacagctccactgtgcatacctctggtggagacactctgaggcattctctgaaacctaggggaggaagctaagccttcaaagctcctgaactctgtgcacttgcagagttcgcactacatggatgctgccaagtgctatggcctgtacctcctgaagcagtgacttgagccacacctgggcctgcttgagccatagctgggacagccaaggagcactgtgccagaatgcagggagcagagatttgaggcggccctggatggtaagcctcaagttcccatgggcaccctgggcccctccctcaaacctgttctgcccccaaggccctagcactctgcctgtgaagaatgtggcggcctcaaagatctctgaaatgtcttcgcggtcattttcccattatcttgataaattgttcctggcttcctgctattcacactaatctgcttatcagactgtcaattgggcacacccttggttttctctactaaacatgcttttttattatttacatggccaggctgagaatttttcaaatctttacattctttacatgtgagagcttcccttttgattataaattccatctttaagtcatttctctctttttgcattttgctatgagcagttaagagaagccgtgcaattccttcaacattttgctgcttagagatttctttcatcaagtatcctagttcatcactcttaagttctacctcccacaaaatactgaggcaggaacataattcagccaacttcttggctactttgtaaccatgatggcctttcttccagtttccagtaaggtgtttctgatttctctttaagataccataataaaggccctcactgtccatatttctaccagtattctggtcacaaccactgagataatataagaacttgtctaagatgaactaagaaggttcaggctttccctacagctctccttttgttctgagccctcaccagaatcacccttaatgtgccatgttgggccatacaggctttttcagcattccctttaaaacggttccagcctctacccattactcagttccaaagctgcttctacattttcaggtatttgttgtagcaacactccattctcctggtatcaattttggtctcagtctattcgtgctattataacagaataccacagcctgagtaatgtgtaaaaaaagaaattggctgggtgcagtgactcatgcctgtaatcccagcacattgggaggccaaggccgtggatcacttgaggtcaggagtttgagaccagcctaaccaacatggtgaaaccctgtctctactaaaaatacaaaattagctaggcgaggtggcgcacacctgtaatgcccactacttgggaggctgaagcaggagaatcccttgaacttgggaggtggaggttacagtgagccgagattatgtcattgcattccagcctgagcaacaagagtgaaactctgtctcaaaaaaaaaaaaaaaagaaaagaaaagaagtttattttctcacagttctagaggctgacaaattcaggatcaaggagacagtgaggtccttttggcatctggtgcggtccttttcgctgcattctcacctggcagaaggtagcacggcaagagggccagacgctgtgtgaagcctctgttagaaagacctttatccccttgatgagggaggagcccgcatggccttaaaggcccatcttttaatactgtcacattggccattaagtttcaatacctgaattatggaggaggcacattcagatcacagccataagccaatgtgatgttggaagctcatggacattcttttttgattgcttcagttttctggtgaagtagggagctaagaatgagactgggagaagagacactggcatttcgaggaaagagaaaagagagaaaaagtgttatctaagagaatgagagggtaaacaggtgtgaaatgttgtgtgatgctttgcagctttaagggtacctgttatgttcagccttcactttagagatgaagaccctaagtcctggagaagtgatatgcccgtccttggatcatgcggccaattgaagtggagtccttactagaacccaggactccaaatggccacctcaacaatatttcatgtatgtgctccatgtggtcttctgtgttatagtttagctactgaacataatagatctccaagtcaaaaaggctatttttaatacattttttacatgactgttcacgtaaaaagaaacagactttcactttgagacacttattttttccttcaagcctgtcttgcagattccatcagtacaaatgtcttatttattaaaagtacaaagacagactttgaagcagaaatttaaaatgcccacctgggaaaaaccagatgaaatcttcacgatccagttctgtgacaggtgagccagcagcaggctccccatgtctcctaagatacgggcttccaccagagaaaagagaatatctaaagtgctttaatgcaacctgtccaaaagtaaactttttctttctctggtgaagaagacaaaaggaaaactttaaatctactcgaagtttgtaaaagaagcatgacaactcttgcctagtagggctgtggctagggctggttcctagagtggccatgatgatgggaggagcatgctaggattggttcctcagctaggcctccagacaagtatgggggcaccaactttgtgtaactaccttcccactcattttgagagccacagagtttgcaccctgcacttgctgtctggtggctttcaactcccattgtcagcccttccttggagagatgtattatattaatactttccattgaagggcacagtttggtgtcttattaccttcttacaaagatctagagctgcctttctctaccagggctcctcatctgaacctcagagcatgggaagtgatgtgagtaactgtttcagctcaccagagaacaactacttgcacgtatagtagttgctgtccgttgtccagtcccagaagaggttcagccactcacacatctttccaaaattggcgaactctgttttggtacagcaaggatgatgtttgcaaaatgctgagacaagcaatcactacagaatttttcaaatctaatgtattagaagatacagagatgttaaaatgttggatatgttaaaagttatcattgtaattggaaaatgtgttgcttctttaaactgtgatggatcattatactgataaaatttagtattcactctatgggaaaaagcccaagctctgctccaaacattttatttctacattaattctgctaatttcatctttcctccttccctcgccctttggaagggtaaaatatttaagttgaagagaaaaatctaattttaaaaacaatttttgtttaaaacttgtttttgattttcatattatatttatatcctgtctataaacagaatcaataatgaaagccatagattatgatggaagagcttcttaggtccatactaaaaatgaaacaaaagcttatacctttactagatttcaacataaaaaatatatgcatatgattaaagaaacccataaataaggggaaatctcacagaagtgaaataagatttgaatatggaaagaaaaggacccaaaagtcattgcacattcacagaaatctagttttcattataaagatcatcttatgacatgcttttgcaacatcagtaggtagaatttcttttagcacagagcctgaccacactttctttcaaaaatatggagttaatatgtcacttttgaaatcattattatgatttttattttctcaatgttatactgaacacactgaatttaggactgaggcaaatgagagttagtctcctagtcacaactatatcttttacagactaagaattttgcaaaaatcaaagcatagatataagttcacttctatccatctaaagaagcacaaaaaaagagctgttttaaaaggtcatgtcataggtgggtacagtcccattgtttagctgcctctctcttgactctctgacctgggacattgtggggatttgcctcattgcaatagttgcaattcctggtcccagttctcttgactctatccttgaagtcagaagtattagacagaaaaaaaatggagacttgaatttttttagagaaaacatgtgtgggtagatatttaactgattaatgtcctcttaattacttgaacattactagccaatacatgtgagcttttgcagacaaagggttgcagccatatcgtccaattcttgttggttacatgtcaacaacctgtgatccactgcacctgtaaaatactgttagccctattttcactctcattatttaatacaaatgatcactgttcttttttattattttctcttcctttaattttcttactcccagtttttctccaccactccatcttcttcttgcataaacctctgctggtatctaacattctttattctcaagggtggcatcttaaagggcgtttcagatctttgggtcttacattaatttagttgtgggtccacagctgggaagctcagtatcaagactgcccaatcactgataagaagagatagatggccaggcacggtggctcacgcctgtaatcccagaactttgggaggccaaggtgggtggatcatgaggtcaggagatcaagaccatcctggctaacacggtgaaaccctgtctctactaaaaatacaaaaaattagctgggcatggtggtgggcgcctgtagtcccagctactcgggaggctgaggcaggagaatggcatgaacctgggagatggagcttgcagtgagccgagatcgcgccactgcactccagcctgggtgacagagtgagactccgtctcaaaaaaaaaaaaaaaaaaaaaaaaaaagaagagatagataagtcagctggtgatcacacttgacagaggctaagagtgaaactctgcctaggcgatggggagggccaggagcaggggcccatgctgtgaaaggtaagccctcaaacaaggtgaacagcggtgaagtaagggcttattccctcctcgaagattttgttactatcttgcccctccgcagatatgatcctttaaaggtttcttatcttcttttggagaaaattctatactcccctcgttttcaaggacatctccaaattggttccaaagggtctttctattcacagcttccattagtcccttgcaggctcctaggcaaacaagatcatttatttatttattcattttcttaaaagtacacccatttccagcctcattcttggatcaggcccagcatggccttccctctcatatgtgcacacactaaccaactaaagatggattctagatctccatcacgaagactcctttaagcctcccagggaggaagaaacttcaagcttaccatgaggaaaatattttcttttttatacctctttcacagagaaatctttacctttctatactgtttttatgtagttttaagttatgtcacgaatattgtagtgtccccattaacctctaaacttcttgaaggaaggaattgtgtctaaccctttttctgccttaatggtagtaaaattttactgattgaagaatgaatgtggaaggatgttttcgggaaatagccttttgtttaatactcagtaggttggtttctatcttatctcttcataaaacttcacaaagtgacagaattccttcctttaattgagatcattctcagctctagtctacctccagatggtctgttttaaattaacggctcaaaattttactactcttgagaacttgggcaaactaatcaaccattcttagtctcagtgtgctctttataaaatgaagaaaacgttaatccttccactgctttgtgaggcttgaatgagatgcgagtccctcagttcatctcagggccctgtgctcagtaatcatccactcttaggactgagctgaaagaacaagcacattcaaggaaacaatggggtttggttttttcccaaaaaagtatttttattgcttggcaaccaataaagagttcatagttcttctacctcttctttctctttttatttaaataagcaggcaatcaaacctatagatttttctgttaaaaatatattcattatgtagacaaaatttaagaatgttagaaaaactttagtgtagagacaacaaatgtcatataattaaatatgcctatgattattttgatttacatgataccaagggtctgtgtaggaagataagtttagcccaaaacaatcttagctgaagcaaatgcaaaacaggaaatttagacacaaggaaataaacactagtcctaaagtatgctctttaaaatagctttaacgcagcatagagttttgcatctatatttgtgaacaaaattatccatgcagctgtccaatatcttgccagaattgtaaacttcaaattaggatgcaaactcaatgtcactcaagaaagtggtcatgaggctggacttagtcattggtaattattctggattcatcagcaagggcagagctgattttaccatttcataacacaccacttctgaacagtttcctcccaggtgcttaagaatgaagaagtggctgtcaggactgcactggcaatatttttcaaaatgtggatccctggtcatattaaaataaaagtttttcccccatcaggttagcagaaatgtaaaatggagattggaatttagatgtagagttttgtgtcagaaccacgtttgatagtcagttacacacatctggcccacagttaagaatgtaaactaacagcattaagagccagacatcctgggttcaaataccagctctgctgtataaggcttggcctttctgtgcctcagttgtctcacttgcaaaatcaggatgatatcatcctccaaggattactgtgaggattaaattgttaatatgcttaaagtgcttggaacagaacacacgctctgtgaagtcattactattatcattacattaacacttctctttttgaaaaaggacactttttctattagttaagacaaagcaagccatatatttgcaaattcctaaaacaatgattgaaattaaaattctataggagaatgacttaaattttctttgtaatcagaatagatatgcctccagttccattcttgaagcaggatacatgccaaggtcagaaggaaggtgacttctgctttcacaagcctgtgagagaatgggatccgggatgagtcctctgactcaggggctcacctttcccaccatgtcatgcaacgcatcaaggaggctcatgttctttcaatttaaggaatgcacatttcattgcttgaaagaggaaaatttaaatgtttcttcaaaggttatacagaatattatgacagacttaggacaacaaacaatgcttctgttaactgttagaggtctctttggcagtgttattatgagttaactgctcagtaagaagatggttaatattgagtgtcaacttgattagattgaaggatgcaaagtattgttcctgggtgtgtctgtgagggtgttgccaaaggaaattaacatttgagtcagtgatctgggagaggcagatccaccctcaatctggtgggcaccatctaatcagctgccagcgaggaggcaggagaagatggaagagcagactactgagtcttccagctttcatctttctcctgtgctggatgcttcctgccctcgaacatcagactccaagttcttcagcttttggactcttggacttacaccagtggttttccaggggctcttgagcctttggccacagactgaaggctgcgctgtcagcttccctacttttgaggtttggggactcagacggaaccaccactggcttgcttgctcctcaacttgcagacagcctatcctggaattttaccttgtgatcgtctgagtcaatactccttaataaattccctttcgtatatacatatatcctattacttctgttcctctagagaaccctaatacaagggattaacatcagaattttgaattcacctaaaagcaagtgaggttacatgaagtaagcacaagaatgtcctccaaaatgtaccttaaattaaatggaaagtaaagaagacatgagagtttatttttatattactgaatgttgtttcttataaaaggcatactttaattcagtaagtaatttgagagggtctgaagactaaactacatgttaaaaaacattgccggctggatgtggtggctcatgcgtgtaatcccagcactttgggaggctgaggcaggcggatcacaaggtcaggagttccagatcaccctggctaacacggtgaaacctcatctctactaaaaatacaaaaaaattggcctggtgtagtggcacatgcctgtagtcccagctaatcaggaggctgaggcaggagaatcgcttgaacccagaaggtggaggcagcagaatcgcttgaacccagaaggcggaagtagtagtgagccgagatcatgccactgcactccagtctgggtgacagagcgagactccatctcaaaacaaaacaaacaaaaaaacaaaacaaaacattgccaatgtttccatattgtgggaaagctatttattgggaaacagtttactattttattagaccatgcagattatggtgatgtgatattatacctagagaaatacaatatagaataatattacagtttttttaaaagagccttctacatgttgcaaaaatctgatttttaatttaatagtactttaagtaatcaagaacattttataaagaaacagcaatgattagtattataaagattatctgtttgttttattaatcatggagaaaagttgtcacaatacttgccctttatgatatttcaataagaatcacctgccaaataatatggtgatatccatacccacaacaattccattgacttatgagctaaaaatttactttttactgcagatggttggttcccatgccctgagaaacacaagatgctccatggaaatgctgatgattttaccttcataaaaccagttttattcacatgtcacatgcctcagaagtcaagcacaacctactcaaaactttagctctgcagtatagaggtctccttcttctccaagctaagatcttttggggaagaagagcttataaattgatcagaatttgctcccacaagttccagtaagcagagtagtaactgagaacccaggctttgtggccttataaatctgaatctactagctgtgtattcttgggaaagttacttaacatcttggagcctcaatattctcattaaaaaatgagaatttaaaagtagcattgtcataggtactgatggctatgtggtgtcatgtgattcttggcgcaggtccttcatgacattgtaactattgttttaattgcaccatgcactacaaataaaatgttgtatgaattaaatggagctaccttaactaaaataggtggtaattaatgaaaaatgctaatcataaccagaaaaaaaatttatttttttctttttaaatcaggatccctgataaaaatctacccagaatacaaatctacccaaaatgagattatcatccacaatctcatgtaaaaatatctaggctggcacggtggttcacgcctgtaatcccagcactttgggaggccaactggggcggatcacctgaggtcaggagtttgagaccggcctggccaacatggtgaaacccttcccctactaaaaatacaataattagtggggcatggtggcgggtacctgtaatcccagctactcaggaggctgacacaggagaatcatttgaacccgggaggtgcaggttgcagtgagctgagacaatgcctttgcactccagcctgggtgacaagagtgaaactccatctcaaaataaataaataaataaaaatatttaaaacctagattttttaaaaagcatttggtagcctgaccaataactggagagagaaaaagtgatgctccaagaataaactattatattttaattctcaagtcatttaaattgataattttatgggtccttgcacataaacagctgaaatgttaaatcaattcattaaagtgttcataaattcactaaatgttcttaatcatcattaagccttaaacaacctgtgacatcaaaatgattacagagaaacagtgataaattactttgagttatcaactatatatttaaatactgggatactggtctaagttatttggtattttaggggatattaagtattccatctctaatataatttatattatgtcatgcttcccataagtttttaaacagaaactttaagaaagtgattatgcacttaaaaaatcatatcaagcaatataaaatctgaacaccagattggtacaaaacatgaatatcacataaaagtaacctagcattgaaaatgagaagctgttaccctgtgaaattataatgtaaaaacacactagataaaatgcagtatcttgagtataatctgttacaaattctgaaattgtgtacaaaatgtatattatatggattttaagacctctcccaaatgtagacttttgacatacctggcctgtaaaagatatataggctgacagacctaggggaaaaaatgctatgttctgagcccaatgttcctctttggtccataagtatcatttacaagaataatcatgattctctgattccaaactgttgcccccattatgagccgattgctcatacctgtggcaccagtcactccatcaaacctttattctgggctgcacactcctggaaggaaccataaaggaggtctgagggcaaatatcctttgtgttaggatctggctcatgtccacatcccccttgctggtgccatattcaatccatgaggacctactggattctagaccttagtagtagacataaaattccagaacagtttatggaattttactatgtggtccttctgtttcttagcatttttgtcttaatcagtttaggctgatataataaattatcataaactgcgtggcttaaacaagaaatatttatttcttatagttctggtggctggcaagtccaagatcaaggcatcagcatggttgagttccagtaactgctgattgcagactgctgatttcttattttattcctacatggtggaaaaagagcaagctaattctctggcctctcctgtccaatttgtaaaatttcatattcagacatgtaaaagttataatgcttatttcaaattgagaatcagtagggtgataggcattttagcaagaaacataattatctccatatataaactaattttaaatattacagtttagttttccaggtactaattccttggctcatataaaatgtatacttcagaaaatctctttccttgtttctgctttttattccaatattataacttctcataaaaaatgaaataagataaatttaaatgctgtgtaattcagctatctggaaaaggacatcattcttctgatgacactgaacatgtagatgaggaatcatagtggaggaaagctatcttagtgggaccaagtatcccagtggtcacagacttaagggaagggattcaggatgttagggatgtaggggaggaaaaacaccatttacttccactatctttttgtccatagtcaattttgtctgagagtagtgattgctttagaggtgaagagctaagaaagacagattcatcttcatttctgaccatttcacctccaaatatgcattaaaagcactagtgtaaactaattttattactcctatcctcctgcaagcctggaggacattgcctgtgtcccccacattgacttcttcaagcagtttttgattcaattgtttccaccctgacataacataaaagacaatatggaacccacaggtaacatttatatcctggaaggctttctctacctcagagagatgacagatgtctccatgtataaagttgattccttccagaatggtttgagcagggatacttatgtcaaacagaatcatatggactcccttctgattcagaaacagcctaggcagaacccaaaatatctaccacttcctgtaatgacaacaatttctttttaaaaaaataattttgattttattttatattcaggggacatagctgcaagtttttacacaggtatgtggaataatgctgatgtttaggatatggattccatcacccaggtagtgagcatattacctaacaggcagtttttcaacccatctcccctccctcctgccccttccagtagttcacagtgcctagtgttaccatatttatgtcaatgtgtactcagtgtttagctcccacttacaagtgagaacaagctgtatttggttttccattcctatattataacaatttacttagggttatggcctccagttgcatccatgtttctgaaaaggacatgatttcattcttttctatagctgtgtagtattctgtggtgtatatgtactactactacatttttaaaattcaatctactgttgataagcacccaggttaattccatgtctttgctattgcgaataatgctgttatgaacatacaagtgtatgtgtctttttggtagaatgatttattttcccttgggtatatgcccaataatgggattggtaggttaaatggtagttctaagttctttgagaaatcttcaattgctttccacagtggctgaaccagtttacattcccctcaacagtttataagcattcccttttatgcacacacagcctcaccagcatctgttgttttttgaccttttcataatagccattctgactggggtgaggtggtatcttattgtagttttgatttgcattgctctgatgatagtgatgttggacattttttcatatgtttgttggccacttgtatgccttcttttgagaagtatctgtccatgtcctttgcccattttttaatggggttatttgtttgttttttcttgatttgtttgagctcctcataggttctggatattagacctttgttagatgcatactttgcaaatattttctcctattatgtaggttgtctgtttactgacagtttctttcgatgagcaggagctttttagtctaattgggtcccacatgtcagtttttggttttgttgcaattgcttttggggacttagccaaaaattctttgccaaggctgatgtccagaatactgtttttcctagattttcttccaggattcttatagtttgaggtcatacatttaaatcttgaattcattttgagttaatttttgtatacgataaaaggtaggggtccagtttcattgttctgcatatggctagctagttatttcagcactatttattgaataggggacccttttcccatttttttgtgggctttgtcaaagagcagatggctataggtgtgcagaactgcttctggattatctattctgttccattcatctgtctttttttgtaccaggaccaagctgttttgcttactgtagccttatagtatagtttgaagttgggtagtgtgatgcctccagctttgttctttttgcttaggattgctttagctattcgggctgttttttgattctatatgaattttagaatagttttttctagttctgtgaaaaatgacattggtagttatagcattaaatctttaaactgctttgggcagcatggtcattttaacaatattgattcttccaatccatcagcatggaaattttttttatttatttgtgtcatctgtgatttcttccagcagtggttggcagttctccttgtagagatcttttttctttttcacattatggaacctttacttttcatgtgatttctgtacataaggagtatgagagtaaccctttcacaaatgaaactaatctactagaataaacaatgacaaaactgaactggtatttgatgtaaatccacaggcgtttaagcttcaaattcagcatctgattcttctgagatctttccatcagccctggtagtgcccaacagggcttggtgccagctgacatgagacaagaaagcattctcaaactttgtaatcttgctgggctcccgtttatcaagatagcccctaatacccacatggataacagccacttgttcttcaatagccatgggagtatactgtctttgcttcagcaactcagttagacacacaccacaactcaaaagttgttgagtggcagcatcgaggtcagaactgaactgggcaaaagtggtgacctcagatactgagccacttccagcttcatggtacctgccacctgcttcatagccctggtttgggcagcagatctgacacgagacacagacagaccgacattaatggcagggtggatacctttgtagaacaattctgtttccaagaagatctgtccgttcgtgatagaaatgacattcattggaatgtaagcagacacatcaccagtctgtttctatgactggcaaagcagtcaaggagccaccaccaaaagcattgttcatctgggctgctctctccagcaactgggagcataggtagaacacaacaccaggataggcctcacaaccagggggttggcagagcaacagaaacatctgatggtaagcaacagcctgtttggataagttgtcatagatggtcaaagcatgttggccattgtctctaaaatactctcccatggaacagccagtgtaaggagccagttactgaagtggggcagcatctgaggccgtagctgacaccacgatggtgtaattcatggcatctgcatcgtaagtctcttcaccaactgggcaacagtggatctcttttgaccaataacaacatagacacagtacagcttcttcttttcatcagatccatcattgaaacatttctggttaatgattgtgtcaatagcaattgagattttcccagtctgtccattaccaataatcagctcacactgaccatggccaattggcaccaagctatttacagccttaatgccagtctgcattggttcctgcactgaaatttgaggaatgattccaggggctttcagaccaactcacctatggttcttggaaccaaatggaccctttccatcaatggcattacgaagggcatcaaccacatgacccaacagctcctcaccaactggaatgtccacaatggctcttgtcctcttcattctagctccttccttaattagttaatcatttccaaacacgacaacaccaacattgtcaggtttgtagagatctttaaccttcttggttagctgtattcctaggtatttcatttttgtgtgtggctattgtaaatgggattgtgttcttgatttggctctcagcttgaacattattggtgtatatgtaaccagctcaagtccagctgctctcctctcagaagtcaaagcatgagaactgaggtgtggtgaaaggaaagcaacttttattggtcaaatgctagcaaatgggagaatgtctgggcataagcctcaaaagagccatctcagccttctgggccgagtgaaggggtttaagaaggaaaaaggtgtgggatatagacatgagtagtgaaaagggagtgcatatctgcatgtcttgttcccatagttatctcaagtaatctcccatctagagatctgatttacatcatccggacttgggcgtaactccccttgagtgggaagatctgcggcttggtctctctgcctggtttgtttcaaaattggctcctggaatttctaagcaagcacatagttagatgagcaagcactgtacacagatatgcctgtagggaaagggcataacaaagagtcttacactataaggctacattctgagattaggaaggaaaggaaaaaaatagtttaaaaatgtatttcgaggctgaggtactcagatatatatagaaatgctattgatttttgtacattatttttgtaccctgaaacattactgaagtcatttagcagtttgacgggccttttggcagagtctttagggttttctagatatagaatcatattatcagtggccaagcatggtggcttacacctgtaatctcagcactttgggaggctgaggcaggcagatcacttgaggtcaggagttcaagaccagcctggccaacagggtgaaaccccatctctactaaaaaatacaaaaattagccgggcgtggtggtgaatacctgtaatcctagctactctggaggctgaggcaggtgaatcacttgaacccaggaggcagaggctgcagtgagctgagatggtgctactgcactccagcctgggcaacagagggagactcagtttcaaaaaaagagagaatcacactgtcagtgaagagagataatttgacctcttctttttcccatgcggatgtctttgtttgtttgtttgtttgttgtttttgtttttgtatttttagtagagacagggtttcactgtgttagccaggatggtctcgatctcctgacctcgtgatctgcccgcctcggcctcccaaagtgctgggattacaggtgtgagccaccacacccagccgcggatgtcttttatttcttcctcttgcctaattgctctggctaggactgttagtactacattgaatagcagcagtgagagtaggcatcattgtcttgtttttgttcttagggggaatgcttctggcttttgcccggtcagtatgctgttggctgtgggtttggtgtagatggctcttattattttgaggtatgtaccttagatgcctagtttgttgagggcttttatcatgaagggatgttggattttattgaaagcttttttttgcatctactgagatgatcatatgggttttgcttttaattctgttactgtggtggatcacatttattgatttgcatatgttcaaccagccttgaatcccaggagtaaagcctgccttattgtagtaaattaactttttgatgtgctgctggattcagtttgctagtattttgttgagaattttcgcacctatgttcgttaggtatattggcctgaagttttctttttttgttgtgtctctgccagattttggtatcagactgattctggcttcataggataagttagagaggtacccttccttttcgatttttttgaatagtttcaatatgattggtaccagttcttctttttatgtctgagagaatttgtctgtgaatccatctggtccagggcttttctttttctttttcttttttttcttttggggttggcagtttctttaatactgatataattttggaacttattggtctgttcaagttttcattttctttctggttcaatattgggaatttgtgtgtttccaggaatttatccattttctctaggttttcttaatttgtgtacatagagctgttcctaatagtctctgaggatcttttgtatttttgtgggatcagttgcaacgtcttctttgtcatttctgattgtacttatttagatcttctctttttttctttgttaatatagctagtggtttactgatcttgtttattcttttgaagaaaaaacactttgtttcattgatcttttctatggatttttgtgtctaaatttcattcagttcttctctaattttagatatttattatcttctgcttgctttggggttggcttgtttttttctagttcctctagttgcaaaggtacattgttaatttgagacctttctaatttcttgctgaaggttcttagtgctataaactttcctcttaatactgttctagctgtgttccagagattttggtaagctgtgtccctattttcatttatttcaaagaatttttttatttcttccttaattttattgttcaccgaggagttattctggagcaagctgttcaatttccatgtatttgtgtagttttggggagctaggactggctttcagcttcatcctccagacccttgagattgggccccagctgttctgggggatccaaagtgctcccaggccaccaggaaggtactcaggtgaagcaaagcacccaggcttggcagcagaggctactctgtgcacacctcctgcagggtggccaggcaggggccctggaagtttcccagtcccacagggaagccagccacactctctcttgggccagcaatcagctgaggctagagctgcctgtagggaggtggggagccctgggggatgggtgtctaggccatgctctgccacagctccacatgcacaaaagctcctaggctccatgccggtgaagccctgtctctgccaactctctttgaagatccccctgccagctcaaatgtccatggagaatgtgaagttctatatacctaggatcccagaggtccacagtgagagtggcctgtccctccatcccttcacttatcccttccccaggaggcattcaggtctgggaactagccctgtcatgcaagtatcctgtgcagggtttccagcttcctccctcttcagccttgttgtctgcatcacctctgtaatgactctcagcattttctctctgaagatgggctcaaaatacattgctgtactcaatattttggtgtctctcagtgggagcagtgcttcctggctgtgtctagttggccatcttgttatggtaacaatttcttttggagattttttggagtccacttgtggcagtcaaaagataactagacagtggtggcagatgacaactgggtccacagattgcacaacgaagagtagcctgtggcagagagcttatttgaagaaatggctgaaaacttcccaaatctgaaaaacgaaatggacaaccaaatttcagcagcttgaaggactctgtctaagatgaacctaaagatccaacacaatgacacattataatcagtcaaaagtccaagacagacaatcttgaaagcagcaagagaaaggtgacttatatacaagagaactctcataagattatcagcaaactcatcagcaggaacattccagactgaaagggaatggggtagtatattcaaagggctgaaagagaaagaaaactgccaactaagaatagacagcaaatctgcccttcaaaactgaaggagaaataaagatcttcccagataagcaaaagctgaagaagttcatcaccattaacctaccttgctagaattactaacggtagtcctttcagttgaaataaaagaaagctagataccaacttgaaagcatacaaaagtataaggctctctggtaaaggtaaacatatagtcaaatgcagaatctaggccatgcgcagtggctcaagcatgtaatctcagaactttgggaggctgaggtgggcggatcacgaggtcaggagatcgggaccatcctggccaacacggtgaaaccctgtctctactaaaaatataaaaaataaaataaaataaaagtagcagggcatggtggcgggtgcctgtagtcccagctactcaggaggctgaggcaggagaatggcatgaacccaggaggcaaaactggcagcgagctgaaattgcaccactgcactccagcctgggtgacagagtgagactctgtctaaaaaaaaaaaaaaatgcagaatcttgtcatactacaatagtggtccataaatcatttttaaatcaggtataaataagagcataaaaataaccataattattaaattatattaatggatacaaaatactaaaagtataatttgtgacattgataatgtaaggtgaattggaggtaaaagagtagaggttttgtatgcaattgaattaaatttttagtttaaataaattgttatagctataagatgttttatataatccccatggtaacttacagagaaaattgctatagaagacataccaaagaaaataaggaagtcctcaaagcataacactacaaaaaaatcaatgaaacacaaaggcagcaagagaggaaaagagggacaaacaactctaagacatactgaaaacaattaacaaaattgcaatagtaagtccttccccatcaataattactttaagtgtgaatggattaaactccgcagtcaaaagaccgagtggcggaatcaattttaaaaagatccaattgcatgctatctacaagagattcacttagctttgaaaacatacacaggctgaaaatgaaggaatagaaaaatatattccatgcaagaggtaaccaaaatagcaagggtgcccatacatatatcagacaaaatagacattaagctaaaaactgtcacaagagaaaaacaagacacatcatattgatgaaagtgtcaattcacagtacaacacttataagtctatatgcaccaaacagcagagcacccaaatacatgaagcaaacattgatagaactggaggaagaattagattaaaaaaataataggaggagattacaatactctttttcaataataaatagatcaaccagaaagaaaaataataaggaaataaaggacttgaacaatactaaaagtgaattgactctaatagatatataaacaatattccaccctatgttaatatacacattcttctcaggtgcacataaaacagtctccaagacagaacacatattaggacacaaaacaagttttaacaattcaaaaaaaaactgaaagaaaaccaactatattttctaataatcatgaaactagaaatctggactagaaaactctgaactagaaaattcacaaagatgtggaaattaagcaatatactcttgaacaacttgatgagtcaagaaatcactatttaacagtattttaaagcaggtgaaaatgaaaacacaacacaccaaaactgtggcagtaaatgtttgtatttttaaaagaagatccccaatcaataattggagataattttgtatctcaaagaactagaaaaagaatagcaaactaaatccaaagttagtaaaaggaaggtcctagattacagttagcaaaaggaaggtcgtagattacagaaaacataaatgaaatagagaataaattaaaaaaaaatagaaaaatcaatgaaataagagtttttttaaaaaataaaaaatttaacaaattctttcaataagtaagaaaatagaagtctaaagtagagtaacacaaatcagaaatgagacattaaaaatgaggacgcagaagtaaaaagattacgagagactgctatgaacaatactccagtacattggataacttagaagaaataaattcttagaaatatactacctaccaagattgaattgtgaataaattaaaatctgaacacatctataacttaggagattgaattagtaatcaaaaatctcccaatgaagaaaagccccaggactagacggtttcactgatgagttttaccaaacatttaaagagtagttagcatcactctttctcaaactcttctgaaaaatttcagaagaaaaaatactttcattttatgaggccagtattaccttaataccaatgctaaagaaggacaccacaaaaagactacacaccaataatcttgctaaatgttgatgcaaaaattctcaacaaaatatcataaacttaattcagcagtacactatgaccaagtggtatttattcctgggatgcaaggatggttcaacatacaaaaattagtcaatgcaatacactatattaactgacagaaaggtaaaaaagtcacatgatcatctcaattagtgcaataataagattttaataaaattcagcaccctttcatgtaaaattcaataatatagaaataaaagaaaattacatcaacatataaaaagccctataggtaatgcccatagctaccatcatactcaagctttccctctacaaatagaaacaaggcaagcatgcccagtcttgccatgtctattcaacacagtactgaaagttctagccagagcaattaggcaagaaaaaggagtaaaaagcattcaattttgaacggaagaaataaaattatctctgtttgcagatgatataaacttacatgtagaaaacctgaaggattacacacacacacacacacacacacacacacacacacacacagagagagacaactgttacaactaataaactaattcagtaaagttgcaggaaacaaaatcaacccacaaaaatcagttgcatttctagacactaagaataaataatcagaaaagaaaatgtttttaaatcccctttacaagagcatcaaaaagaataaaatacttaggaataaactcaaccaaagaggcaaaagacctgtatactgaatactcttaatattgctgaaagtaattaatgaagacacgaataaatataaagacatcccatgttcctggattggaaaagaatatggttacagtgttcatactaccccccaaatctacagattcaatgcagtccgtataaaaatctcattggaattttttgcagaaacagaaaaaaaatccaaaatccattaggagtctcaaagtattccaaatagtcaagacagttatgagaaagaaaaacaaagctggaggtctcacacttctcaagttcaaaaaacagtgtaaagctacagtaatcaaaatagcataatactggaataaagacacacatatagaccaatgggccagaatagagagcccagaaataaactctcacatatgtggtaaaataatctgccataagggcatcaagactatacaatggggaaaagatagtgtcttcaacaaatggtgctgagaaaacttgatattcacatgtaaaataatgaagttagacccttaccttcctgtacctatatacaaaaatcacttcagaatgaattaacggctaggtgcagtggctcacgcctgtaatcccaccactttgggaggctgaggtgggaggatcgctcaagtcctgggcaacactgcgaacccgtctctacaaaaaatgtaaaaattcccccgggtgtggtggcgcgcaccctgtagtgccacctactgggagaggtgggggtaaggcaggaggattgcttgagcccagaaggttgaggctgcagtcagctgtgatgatgccactgcactccagcctggttgtcagagagagaccctgtctcaaaacaacaaacaaaccaaaatggattaatgacctaaatgtaagacctaaaattataaaactgtaatttataaaattatatttataaaactaaaatttataaaattataacattatctagtaagataaaaatataggggagaagcttcatgtttttggatttggcaatgatttcttggacatgacaccaaaggcagaggaaataaaagcaaaaatatacaaatgcaactaaatcaaacttcagatcttctgcatagaaaggaaataatgaagagagtgaaaaggcaacctacagaatggaagaaaatatttgcaaaccatgcatctgatgagggttaatatccaaacatatagagaattcctacaactcaacaacatcaaaactagacaaacaaacaaacaaacaaaaaaccctattaacaaagtatttgaatagacatttctttaaggatgacatcaatatggccaacatttaaaaatatgttcaatatcactaatcagagaaatgcaaatcaaaaccacaatgagatgtcacctcacatctcttagctagaccactatccaaaaaaacaaaacagaaacagaaaataagaaatactggcaaggatatagagaacttgaaacccttgtgcactgttggtgtcaacgtaaaatggtgtagccactatggaaaacagaggttcttcaaaaaatttaaaacaggactaccatatagtccagcaatcccacttctgggtatatatcaaaaaaatttaaagtaggattttgaaaagatatttgcacatccatctttattgcagtattactcacaatagccaagagttggaagaacactaatatctcctgacaaattaatgtataaaccatatattcactggaatattattcagcctaaagaaagaagaaaatcttaccatatgctacaacacggataaggcttgagcacattatgctacatgaaatatgccagtcatgaaaggaataatgctgcatgattccctgtgtatacattttcgaaagtaatcaaattcatagaaacagaaagtagaatgtgacaaccagagctagggaagagggggaaatggggagtttttccacgggtacagagtttccctttggcaagatgaaaaagttacagaggcctattgcacaacaacttgcatacagttaacagtactgtactgtacacttgaaaatggttaaaatgttaaattttgttattttttctttactcacaaaaaaggaatgaggagctgatacatgccacaacatggagaaccctgaaaacattatgttaactgaaagaagtcagtaacaaaagaccacatattattgactccattcataagaaatgtccacaataggacaatctactgggagaaagaagcctagttgctgcttaggaagacaaggagtaatagctgaagcatgtggcttttttttctttctttttttttcttaagatggagtcttgccctgtcacccaggctggaatgcagggttcaagcaattctcctacctcagcctcccaagtagttgggactacaggcgcgtgccacagtgcctggataatttttgtatttttagtagagacggggtttcaccatattggccaggctgatctcaaactcctgacctcgtgatctgcccgcctcggcctcccaaagtgctgggattacaggcgtgagccactgcgcccggccatggcttttatttctgaggtgataaaaatgttcaaaagttgactgtggggatggttgcacatatctctaaaacactaaaaaatattgaattgtaaattttatatgggtgaattgtacggtgcatgagtcgtacctcaatgaagctaggtagaaagtaaactctattgtcttctctttcccctggcgaaacacctcagcttagggcaagtctgaacagaaaccttgcctctcagtgaaggaaataggagtcatctcaacttcacttgtagtccatctaatcatctatgccaccacagctctctgatatctttaaaacgattacatttccaatttctttactttttgaactacttgttccagtgggagtgatgcagtgccactgcctcctatattctacctagaatcagaacttcagctccaatccctttggcctgatttctgctcctcaagtaccccaaagcctttcccacttcactgtacttaccatttcctcctcttgaaatggttttctttcaaatagccgctaggcattttctcattacattcatttcttcagggttaatgccaccaaaaagccttccttcccagactaccctaactagctggcgcacttttaccttctatcactctgtaactcccttccctgctttattttcttcgtggcacttgtcactctctgacaccctatatagtatatatgtttaatgactatttcccttactagaatgtaagtgccaggggctactttgtctttcttgctcttcactgaattcccaacacaagcattggaactagtgtatagtgcattcccagtgaatactgagtgaaagaatacactccactttcaatgggtcctcctggttacaacttcctgtatttttttttttttttttgagacacagtctcgctctgtcgcccaggctggagtgcagtggcgcgatctcggctcactgcaagctccgcctcctgggttcatgccattctcctgcctcagcctcccgagtagctgagactataggcgcccgccaccgcgcccggctaattttttttgtatttttagtagagacgtggtttcatcgtggtctcgatctcctgacctcgtgatccacccacctcggcctcccaaagggctaggattacaggcctgagccaccgcgcccagactacaatttcctgtattattcagtctgtgcatttttctgtattgctgggcactgggttgtcaggcagctgtgataggtgtcaggactaaaacaacgaacatgcacagcctctgtccataggaacttacttattggggattcacacaaataaaatatgcacttggatttgagggagtaaatgatgtcattcgtggaacacacaaactgtaaggagagatgatcaccgcatgtcatgacaggcagagtaactgaacatagaggtgagtgggagaagaccaggaacctctggtggcccagaggcagggtacacggtttataaaaagaaatgcctggccaggcacagtggctcacgcctgtaatcccagcacgttgggaggctgaggcgggtagatcatctgaagtcaggggtttgagaccagcctggccaacatggtgaaaccctgtctctgctaataatgcaaaaattagccaggcattgtggcaggcacgtgtaatcccagctacttgggagggtgaggcaggagaatcacttgaacccaggaggtggaggttgcagtgagcagagattgtgccatggcactccagccttgggcagcaagagcgaaattctgtctccaccccccccccacacacacacacaatgcctgcagagttcaaagactgaagaaagtaagtgccctgtgcattttctaataaagaggctttgttgaccctggaagggaccgctgcagtagaatagtggagaagatgccaaactgcaggaggctggagagagaatgaaatgaatgaggaggggagcatggacaactgtaccgcgggtctgaagaatgtagaagatatagggaaatacttagaagcaaacatgatggttgagagtggtcatattgattggttaaagataggacagaaataaataagtgtaagtgttgctggggaagtgagccggtaggatggagaattttcaggtagaggagagagggataagctaactgaggtaatggctgagctaacagagtacaggtagaatggttgggcatggagggagatatatcttcccctaggcaaggtgggcacagagataggtgaatgcttttaggaacgaaggcagaagtgagagggaacaaactcaaatgttatacttttttctaccataatacccagcaccctttgcctggcacataacagatgtctagtaagtaagtgcacaataaatgaattacactttcatatggtgatgtaataaagaaaactaaagcacaatagaagtttgaaatatgctctgtgggaagtgaaagagaaagttgcccaggaaaatatagaaataccaggtggtattccaattgagtttggcaactatgcctttcaaatgaacttttaatgcagttatatgagtttctccatctgtaggagagttgtttgtgtaggaggagaacagaagacggtctggtggatgatgatgtggaatttttttccacaggaggtacggtaggaagacaaagtagtagagtaatgggaatactgataaaggctgtcacactaacccaattcattctttacaatacaatgaagaaaggcagagtggaggtgacgagtgatggctggaggaatgcagtttggaataagtgtgtatgtatgtgatattataatagaatatttcgaagctccagcatgtctaggatttggctgtggaagtggatggctgacaatcctgagactgacaagatcatgcaacttagagtttggagtatgggaaggggtgtcctcattgtccttttcaaatctcttctcgagatacatggtcatttcaccatgaattgtgagtgtatcacacataatttattacgaataatcactgtgaattttttaataatataatttagcaactactatgtgccagatacaaaaatgatggtgaaacttagagaaaaagcttcaaagtcttcagtaaaagcaagagtgtgagaaagaagtacagggtcacatggctggatgttgtcagcctcaagggaaagggtttgtttcagaggacgaatggtctggaactgcactgaggatggagaacactggcctctcctcccaaccccaagaagcctccaactctgagaagcatccctttgaattgctggaggtgggaggtgggcagtgtctttatagaaggctcacttaagtcaaggtgtgtaaggtagaggatgtggagggagttgatgagaatggaatggtgttccagagagagtatggtggagacatttggaggcagaatggactaagagaaagaacgaagagagcagattaccttttgagtggagtgtaaggatgggagagatggaggcataatctacaggtttaggggtaggaaagacggttcaaaccacctgaagaggagggagtctgggtttagaggaaataacatatttgtcacaatccaggaccttcaccacacagtctttctagaaagaagaatgaagcctcttctatccgagggagcactttaattcaggctccattctgcatcctctgcatgaatgctgcaaagtttccatatttgtctgtgcctgtgtttccccatttcttcaaaaagagaaaaaaggggaaatgcttccaaacttttatgtggctgctagaattgtatgatcattttatataaatatatatgaatatgcatagtttctgagagagagagacagacagaaagacagagagcactaacacagtgcctggtatataacaaggactcattaattaatgatggttgttactattatcagatttctatctttactgaattcttgttgatgttacattaatattagtgtattcttaccatgtcatagtgaagcacatttgaacatgtctggcacggtcactggtaagttgctttctatgaacacatctttcctgcctcaagggttgatgtgtgtgaggcaataataaagcaataatataaattctgtataccagaaggaggactccgcatactcctttcactgccccatttaccatggtagaatataagacatgcatcttttatagtcttatatttatttttagagcctgacctgttgccttatttttgctcaaaaacattgataattgaatttttttttgtgtgtaagcaaaaaatcaattaaatatgatattctggatataattcttatatggtaactttttcaattgaacattttccctaatactagtccaggcagaataaaaaacaatgttcttcgttctggaaatgtgacagtttactcatccacacgaacatttggaaaatttgcccacatttctagatcttcaaagtctgaagctctttttccgtttatctcatcctaaacaaaatttaagtacaatgaggaggagctctcagtaatctttttgtccttagtggctttctgcttttctttatcatgggctgcactactaaaaataaattggtacattgttggccagctccaaaagaattgatgatttaacagtcaaataatatatttcataaaatagtaattacagatcaaataatttgttttcactcactacagaaaatgtaaaatgttgccaaactggcaactgcttaaacaaaaacaatatcagttccagaaattccacacgtatatattataatatgcaatatctataatcttaacagctttgtaactaatgaactctaaatggctacatactgttataattttgtatttagatttttcttttctttctttcttttttttttttttggaaaccgagtcttgctctgtctcccaggctggagtgcagtggtgcgatctcggctcactgcacgctccgcctcccgggttcacgccattctcctgcctcaggctcccgagtagctgggactacaggcgcctgccaccacacccggctaattttttatatttttagtagagatggggtttcaccgtgttagccaggatggtctcgatctcctgacctcgtgatccgcccgcctcggcctcccaaagtgctgggattataggcatgagccaccgcaccccgcctgtatttggatttttctatcctaacttttctttaataatttgatccactgttcaacagcaatcagcaaacatctatttactcagtaacattcatcaagcctttccaactcatataacattattgcttcctaccctaaagaaatctatctgaaaacatcactcatagctgaacaaatcagtgctggagcaaaaactagaattctgatttttggctccagtatatttccatgacctaaacttgtctcttaaacactgactacttgattacaagtccagattctgcagaacactgatcatgtttttctgctgttgttaggacatttgttcaaatgactggtctaaatagtccatattaaggcctctccacagtaatagccttcctagatataaaggatcacgggggagaaaatgaagacagattttttaaaattttgtttaagcccaatttttcttcttctatattgctttcagcacttgaggcacatgaagactttgtacgaccttttctctgaatggaaaatgaattctcctgcactcagcatatcaaatcctgagagactttcctggaccgactttggccacctcaatttctgaaatgttatactgattacttctttaagatattgtttggcccaaggtcatgtaacatatgagttcattctgtgcatgaagctccccagagaacaacggtacacaatgtcagtttggttatggcatctgaaaactcataagagcagactttcattaaaagcagtattacccccagcccttgccttctgagaattcacatatgaataattaggagtctgtaagtaggggcctacctgtggtacatatttctcctgtttttgaagtaaaaggatatttctataaagtttctcaaacattttctactttttcatcattgtcaagtcatttattttttgaagttgagctttacatttacttgcatatttggagtttatagccctgttgttttgttttaaattacaagatgataaaaataaatctttaagtcctttcctaaattcatcagttaattgtaatccaatcatatataaagaaaagtattatttattgcctctatattcatcattaaaagaaatacatataaaattaaaaggagcatgccagttaaaaaccaagaaagaatactgggcttctgagcttaacagggaaatctattatcagactattttaatcattttctaattgtgcgtatgaaagactgacagaaatatacgttgtctttactgagtgctgggagtatgagttgtatgatcataaaattatagtcttaaatatttgagacagacaactttcacagctagtttgcatttaaaaagtaattgtgattgtattagtcaattttgcgttgctataaaggaatacctgaggctgagtgattttttttttttttttttttttgggagggagtctcgctctgtcgcccaggctggggtgcagtggcgcgatctcggctcactgcaagctccgcctcccgggttcacgccattctcctgcctcagcctcccgagtagctgggagtacaggcgcccgccaccacgctaggctaattttttttttgtatttttagtagagacggggtttcaccgtgttagccaggatggtctcgatctcctgacctggtgatccacccgtcttggcctcccgaagtgctgggattacaggcgtgagccatcgcggccagccaaggctgagtggtttagagggaaaagagatttattttggctcacagttctgcagactgtacaaaaagcatggcatcagcatctgcttctggtgaggcctcaggaagcttacaatcatggcagatggtgaagggggagttggcctctcaggtggcgagagagggaacgaagtgccagactctttttaccaatcagacctcctgtgaactaatacaaccagagcccactcattaccacagggaggacaccgagcttttctttttttttttttttttgagacagagtctcgctctgtcgcccaggctggagcgcagtggcgcaatctcggctcactgcaagctccgcctcccgggtccgagccattctcctgcctcagtctccggagtagctgggactacaggcacccgccaccgcggccggctaatttttttgtatcttttagtagagacagggtttcaccgtgttagccaggacggtctcgatcctctgacctcgtgatccgcccgcctcggcctcccaaagtgctgggattacaggcgtgagccaccgcgcccggccgacaccaagcttttcatgaggaacccacccctatgatgcaaatacctcccaccaggccccacttccaacattgcggatcacatttcaacatgagatttggagggcacaaatatccaaactacaccaatgatcaagacagaactcatattctttgatacattcttgatttgtccatttattttattagaagaatttttgaatatgagagtaccttacataaagtatgcactaaataaactgaataaaattgacaatatgcaatgtcaaagacaaaacataatggcagtattatactatatagaaatctacttagagagttaaataatgtagtattgtaaatatgtatcttttaatacacaatgtcataaaatgcacgaatacccatatattaaccagactttttcttaaatggtctcactctgttgcgtaagctggagtgcagcagtgtcatcatggctcactgcagccttgacttcctgggcttgagagatcctcctaccccagcctcccaagtagctgggactacaggcacacacaaccaggcccaggtaattttttttttcatggaaacagggtcttgctacattgcccaggctggtctcaaactcctgggctcaagcaatcctccctcctcagcctcagaaatattttggttgcaaacagctgtaaccacattcaagctaaaggaattggttttttcacacattgagatttaggaacaatgccacatctctcagcactgtttgcatttgcttagcttcattctcaagcaggccttttccctatggtgccaagatggcctctgccatctccatcgatcacttgttccaagtaaaagcaagagagacctatcttgccccaatattggaatattataatctcgtagagggtctatgatcctaatacgattccatgcctacccttggactcacaactagagtaaggaatataaggagccatggttgatgagattagacctggtcaattgctcatgcttgtagtcagaggcagcagtttcacaattaaaagaggttgttggattaaaaaaaataacagagtgttactacattctttctgtgactttaacaaaaaggtaaatggccactgtagtggatattttgcccatgggtgagacggaagtagggctttgagtggtcatagcaggtagaaaattttatggaaaacaatgcctaataaagaaagaaagatgtggagaaagctagtgctttacagaacttcctggggtgaaggaaatcttccatacttatccaatatggtagcaacatattgagcacttgaaatgtggctcatgtaactaaaaaactatatttttagttttgtttaatttaaatatatttacatttaaatagccacagtgcagccttcctcatggtgactttgaagagtcagtctatacgtatctttacaataaagtcattgttccttttagtctttattagtcctttgaatgatattataattaaacaaaaaccaaaatccagcttttggaaagctactattcctcattctttcagaaattgaacagaaaatagctatagatactatgaatattcttcaatattcattttttatttcaaaaaatctggtaaaatgaaagagcatattataagtaattcaaaaatttgattattccaatgtgattgtttccattgtaccatgttggacaagcactgatacaaaaaattttaatataacatgaaaatgaaatcaaacaataaatttgctataaaatgtgcttacactgaattataacatcttttgtagttttcttttcaaattaaaaatatacgactaatttgaatctcgtgaaatattataatccttgtcctgaaaaaagcaggctgaccttggggaaattttaatagtgataagattgagataattgtaaccagttactctttaataaccatcattttctagatatgtgctaaccacatgtacgcacatttccttatctaattacatttgaactttacaataacactttatcttaggatcatttcattacaagagatagttgcctgtcattgaaactagcttaaacaaaacaaaagaaagaaatctagtggaagaaataggacagctgacaggccttgcctaggaagcctcctgaatgctggcatgaaggtttgaggtccaggaactaatgtttcacttattgttcatttgtggcctcctgatgtgtcatctctgcttttactccacatagtttctttgttccccttattttcattaaacattctttcctgtttacttaaacctctgcagagagggcagcctgaattttgaaattccacctcatcttgcagttcagtcacctcacaccaatttacttccttgcctaggaagcctcctgaatgctggcatcaaggtttgaggtccaggaactaatgtttcacttattgttcatttgtagcctcctgatgtgtcatctctgcttttactccacatggtttctttgttccccttattttcattaaacattctttcctgtttacttaaacctctacagagagggcagcatctgcagcatctacaattgaaggaggtgatgaaccaggaaaacctaatgccttggatcttgtaggtcagaggtccaagcctggtccagtcctctctgcctggggtacagggataggaattttatgctcaaaacatggaacctagagagtgaggaccacattctttaagaagtaccaataaaaaatgggtgaggaatgagcttggttcagccagtgaattagataacatgattctgattttaaatttgaggaaacagtctcagagaagttcaaatcttagtctggcttgtgatcagacagaccaaagtatgaaccctgacttatctttcagtatctgtgaaacttttggaaagttactcaccctttctgaatgttcaattatgttgttagaaagcgaaaataaaatgcaacccacataaaaacgcttagcatttacccaactagaagcatataacccacctcccactttttacaccctgccccacagtcaaaggccaaggggagagatggccttgtctatgaatgcacttagacgggcttcaaaagtgtggattacaaaccaaagaaggacagagctgcagaaagctgggtgccctgcatgagagatttatagagatttgatgtttgtttttttacccttgagaggaaaaaagcatcagaaatgaaaataagtatatataagagcaagctagcagtaacattgattaacctctgttattttctttgctctgtgtaatgacatccctgccttttcctacaataggcaatgaattttccatgcaagcaaggtcttgtttattattttcttttgttgtcatgtgaaaatccaacaaatgacattgtattcctcatgtggaagtaagaagtttctagatgctgcaaagagaaaaaagagtttagagaacttgtcaattcagagtcagggaatctgaaattcacataaatgcaggagggctactgggattttccaccagtgtggtattaaacccattttatctagatcttaaaatgcagagataattcagcttatttcatgattatgcatagtaattaattaaaggtagataaatacttatattaattaaaggtagacaactgacagaaggcaaattggaaagaaaatggtgtttggagccacaaagatctgggttcaagttctacctcagctacatagaactgtgtaaccttgggtattttgcttaaatcatctgagactcaaatttttcatttctcaaattgagatattagtattgatctcacaggagtatagtaagtcttcacttaatggcattgacaggttcttagaaactgcaactttaggctgggcgtggtggctcatgcctgtaatcccagcactttgggaggccaaggcgggtggatcacgaggtcaggagattaagaccatcctgtctaacatggtgaaacccagtctctactaaaaaaaaaaatacaccaaaaaaaataaattagccgggcgtggtggcgggcgcctgtggtcccagctactcgggaggcggaggcaggagaatggcatgaacccgggaggcggagcttgcagtgagccgagatcgcgccactgcactccagccggggcgacagagggagactctgtctcaaaaaaaaaaaaaaaaaaagaaactgcaactttaagtaaaatattgtactatataacaaaaccaattttaccatatgctaattgatataaataagagttaagttcctatggcatacagtatgtcttttcacttaaagttgcaatttcaaataacctatcaatgacattaagttatgacttactatacatgtaatgtgcctaagacattatgttttatgtgaacgttgagtgatatttgatgcccagagtatgggccctggagtcagactccctgggtgagctttgtaactatgtggccttgagacacttactccctgtattagagtcctctggataaacagattgtgtgtgtatgtgtgagtgcgtgtgtgtgtgtgtgcgtgcacatgtatgtgcgcgtgcgcatatgtgtgcatatgtgtgtgtgtgtgtacacatgcatatatataagaaaatttatgataaggaattggctcatgtaattatggaggctgagaagtcccaagatgtgcaactgacaagctagagacttgggagagccaatggtgtagttccagtgtgagtctgaggagccaatgtttcagctgagtctgaagacagaagacaccaatgtccaagctcaaaccgccaggcaggaggagttctttcttatttgcacaagaatcagcctttttgttctacttaacagactttctggtgattagatgagggccactcacattaagaaggacaatctgctttaactagtctactgattgcaatgttaatctcatcagaaaacaccctcatggaagtacccagaagaatgtttgatcaaatgtctgtgcaccccatgcccagtcaagtaaatgcataaaatcaaccatcacaccatgtatgagcctcacttacctcaggtaaaagggcaaaatgataaaaataaccttcctagggagttatgagaacccagtaaatcaacagttatgtattttacaatagtacctggtatatgataagcactatgtgtggatatgttgaactaaatacataagtaaaactgaggaaaaggagctgcctcccagaggtgttctcccatccctgtttgtctcagggaataactaatttagttttttcatctcatttaatgtttgagtttcacattcagtcaataatcttataagctatttcttcccctaaacatattattctgttcagaaaaactacttgatttcattataagtagagtaaacaaacaagcaaaaaaacaaaaaaccaaaaaacccttgttgattggcattccaagtgagaaaagcaaaaaaaaaaaagctgcttgtttttaaaaattaaaatatcattgtattgcctattgccttttagaaattacatatctccaaataatacaagtgaaatggggaaaaattaacatagatttttttctctattatttggaatcggatttgcagatgagttaactatattctaaatacagatatcacataggacgaaaaggttaaaaaaaggtctctgttcttttctccttccttaaacattatgcatcaaaatatttacatattttcaagatgtgtcttatcagatattcaatctgtatatattcatagttttaatggactttcatggatatcctttccataagtgatgattaaaaatctcagcttaggtggtagtctgtttttactacacaagcagagcaccgagtttatttaaatctcccaggcacttggtcatggatgtggctgaaggtctatggctcagatgggttgtgtaatatcaagggacagaatggccaataaacactacctcttcaactggattgcccaggaggacacgttgggactcatcaaggaagcaacaaaacccagagagaagagagaagagtgagacagggcagctgcccacctgggattcgcatggagccaaggaaggcttctcaccacagggaaagtgtgagtgggcaagagcccccaggagcccatactcttgccatggatctctgcaatcctgggcacaggagatcccctgaccctctctctccagggcctccagactgacagagcgctgtgcagagtctgggcagagctgccactcaggcacatatggagcctcaagggccttgggctcctgagcatcccagggtcagctgccatagctctgccagcaggtgaggccaggccctcttgcacgctcccaagatacatgctgctttcacagtgctgaggagcagacagactataggccttaccttcgccacaccttgccagccaaagcccacgggcccaggtccccagcgcagccaacacacccctgcctgaacacttaggctagtagtgactctgcacttccctgggccagagctcccagagttaactgacagttccgcctttttgctgctgctgcagcccccacccctactgccctgaggctgcagagggagtaagtgatgagcctaaggactatcatgtgtctccaacgcagtgcagctgccatgcaggaaagcagccagactatttcccctgtggattcctgcccctgctactcctcactgtgcagggcctcccaacctggaccccagcacagtcatcctgcccccgcctgagcacttcagtcagtggtggcactgcttttatctggagaggaaatcccagagacgacccaaaggctctctaccatctcagctgcggggatattgcccttgctgccctcgggctggggaaagaacaaagatcctgactgttttgctggtacctccagcatgctgcagctgtcctacagagaggaacccagtctcttttccctgtgaacccctgaccccctgctctacaccaggcagggcccctggattgggtctgccatgcagccaccccacccccagctgatcattcccattggcagtagctttatgtatctctggggtggagttctcagaggcaactgacgatccctctgacaccactgctacagcggtgcctgctattgctgccaccaggttgggaaagaacaaagaacctgagtgccttattacacctccagcataccacaggcactcaggttctttgctctttcccaaagaggccagactgtcttccctgtaagcccccaccccctgctcaccaccaggcaaggcctccaacttgggtgtgtgacatagccactccaccccgggctgatcattttggttagcagaggctctgcatttctctgggttggagctccaagagataagtgtaaggccctctaacattgtcactgccaaggtccctgcccctgctgcctgcaagctggggagtgaacaaagagcctgagctgagccctcactcattctatgaggccagcattattctgataccaaaacctgccagagaaacaatggaaaaagaaaacttcaggccaatatccctgataaacatagatgcaaaaatcctcaacaaaaatccagcagcacatcgaaaagctaatctactaaatcaagtaggcgttattcctaggatataaggttggttcaacatacataaatccataaatgtgattcattgcataagcagaactaaaaacaaaaaccacatgatcatcatagaaaagtctttcaataacattcaacatcttttcgtgtttaaaaaccctcaacaaactaggtattgaaggtacataactcaaaataataagagccatccgtgacaactcacagccagcatcatactgaatgggcaaaatccagaaacattccccttgagaactggaacaaaacaaggatacccactctcatcactcctagccattgtagtactggaagtcctagcaagagcaatcaggtaagagaaggaaataaaaggtgtccaaataggaaaagaggaagtcaaactatctctgtttgcagataatatgattctatacctagaaaatcccagtctctgacaaaagggtcccagctctgataaacaacttcaacaaagttccaggatagaaaatcaatgtccaaaattcagtagcatttctataaaccaataacatccaatctgctggaatttgctggaggtccactccagaccctgtttgcccaggtatcaccagcggaggctgccggacagcaaagattgctgcctgttccttcctctggaagctttgtcccagaggggcacccaccagatgccaaccagagctctcctgtgtgaggtgtctgtcgacccctgctgggaggtgtctcccagtcaggatgtgcaggggtcagggactcacttgagaaggcagtgtgtcccttagcagggcttgagcgctgtgctgggagatccattgctctcttcagagctggcagagaggaacgtttaagtctgctgaagctgtgcctgcagctgccccttcccccaggtgctctgtcccagggagatgggagttttatctataagcccctgactagggctgctgcctttctttcagagatgcccttcccagagaagaggaatctagagaggcagtctagctacagtggctttgctgagctgcagtgggctccacccagttcaaacttcctggcagctttgtttacactgtgaggggaaaactgcctactcaaacctcagtgatggcttgagtagccttccccccaccaagctcaagcatcccagatcaacttcagactgctgtgctggcagtgaaaatttcaagccagtggatcttagcttgctgggctctgtgggggtgggatactctgagctagaatacttggctccctggtttcagccccctttccaggggagtgaacggttctgttttgctggcattctcaggcaccaatggggtatgaaaaaactcctgcagctagcttggtgtctgtccaaatggccacccagttttgtgcttgaaacccagggccctggtggtgcaggcacccgagagaatctcctggtctgcaggttgtgaagaccatgggaaaagcatagtacgtgggctgtaatgcaccattcctcatggcacagtccctcatggcttcccttggctaggggagggagttccccaaccccttgtacttcgtgagtgaggtgatgccccaccctacttcagctcaccttccttgggctgcacccactgtctaaccagtcccaatgagatgagctggttacctcagttggaaatgcagaaatcacccaccttctgccttctgcgttgatctcactgggagctgcagaccagagctgttcctatttggccaccttgccagccaccctgacttgtttattttcgatgctaacctgtgggttaccaaatattgggaaatggtgtgctgagaggagaatataaagacaaagtgtggatccagtgcagaaaattttacagcttcctgtggaataagaaaatgttggaagcttaagaaacttttaatttacctaataaagccttgtattttatagaagcatgaggcctacccatttttgtttactctatattcattcaactacttttttttcttttattattattatactttaagttttagggtacatgtgcacaacgtgcaggtttgttacatatgtatacatgtgccatgttggtgtgctgcacccagtaactcatcatttagcattaggtatatctcctaatgctatccctcccccatcccccaaccccacaacagtccccggtgtgtgacggtccccttcctgtgtccatgtgttttcattgttcagttcccacctatgagtaagaacatggggtgtttgtttttttgtccttgcaacagtttgctgagaacaatggtttccagcttcatccatgtccctacaaaggacatgaactcatcattttttatggctgcatagtattccatggtgtatatgtgccacattttcttaatccagtctatcattgttggacattgggttggttccaagtctttgttattgtgaatagtgccgcaataaacatacgtgtgtgtgtgtgtgtctttatagcagcatgatttataatcctttgggtatatacccagtaatgggattgctgggtcaaatggtatttctactactttttattttactgtatattcattcaaaaaatgtggtatgtgatgagccacaaaacttaaactttttcctgaaaaaatgtaggaagtcatttattaaaggcttttcagcagacttggatcagatttggagtttatatcattgcacatcaatatgaaggaggaagctagagggaagcatgtctggaggcagtaaggacagttaactatttccataataattcaaataaaaagtgttaaaggcctggatttaggccatttcatgggcaacggagagagaggtggataggagagctgtgatagaaatagaatccacagagctaagaatctattccaactacagcccatttccaccttataaatttaaagtctagactgtgataccactcaaaggctggtcttcttgagtgagtttcctacttcacagaaaattatcagagtgtgtctttaagaatcaaaatttattgactgccttgagcaatgaaaatcttacatcagaggcagaatcaagcatgatctcaattgtgatggtcaaccagctggagctagtaatttttttgttcttttcagaaactaattgtggtaggtcctttgaacagctactccaaaaaccttcacagtgtttgaaacagggtgtggaataggataagggtggtgagaagaggctacttggaaggtgtctttccatttttgagattgggtgacaaggtgtgtgacgatgctgctcacagagaaagggcattcagaggccagaggaaaatcagaaaaatttgggacatgtgaaattgaaagtacctgagaaacagtcaactggagctaacatgaaagaaatgttcatatacagcttttcagcttagcaggaaagtctagtctacataggtttgtaattcaagcatccaagtatatgtgatagttgaaatcatgcaagtgagttacgtccagaaatgttcagtgacttcctcatgtctcaaaccattataagaatgaaactcaggtcttctctctttaccacaattctcaataagacaaaatattagggcaaaataaacctgtgtatgaagtgtctggatctcttcaaatttggaatctgatatcagaaattgctacagcccttaattgctaacacagatagtccctcttttatgtttcataaatgttctgcattttaccctatttctattagatttgaatttcacctttttagtaacttcacttttgaaatgtaaccctaatgattttagatttcataactaattggttaacatatagttggtatgatctttatattatttgttcaggaaagtttctaaagcatttttctttaccaagttttggagaaacggtgtagaatatggatgcggaccactggcctgcattctgaatccaatcaatttaaagagagcttcaaccactgtaaaactcaatgcatctacataaatggaaatcaattgaattgatttttgacagacttgctccactgccttcaattcaaaatctgcttatacatagtgttccagaacaaaatcattatcatgtacaacagaaatactgttttattaaaagcataaaggttacagttttgcaaaagcttcactttacatgaattttcagtgaaataaaaatgtttttaaccacttatactataaatctgtaatatgcttgcactctgcaagagctaataaatctattaatccattgacctgaaaaaggtttaaatgccccaaaattatcagcattaatggttctgattattttctccatgaatttgcactgtgtacaattattatccaaagtatgtgaagtgatgattctttatcgagcttatattaaacatgatacattaaaatatattaaatgctagagtatctgtatcataaaatacattaaaatactgtaccagaatatctagaaagaaaggacttatgaagtagacctgcatgcccttctctctcatggcagagtttgcgtgatgcatcaaaggaagaaagaaagcatattatcttgtctaattgccttgtaaacattataatggcagctctcctggcaaacaaagtatgtgaccttggctagcaagagagaactatgaaatacatatagtaaaatatagctgcctatctagaatcacctgtgtaaatagacctggaatctttaggtttacaggggatggctccaaggaaaatgtcacataaactatgtaactcagtaattcatgacctaagtggcttcttctgtgcaagatctgtaccagaacacatctcatgtgagaagaaatgacccaataagtcacattggggtcccagaacactttctgcttcacttgtgtcatataactgcttgtgtcattgcaattattagcaaaacttgacattgagtaagtactctgattctatgattttcatttaccagtctaattcttaatattatcttaatgcttgcataatatgatatctgaaatcatctcaggtgctatgaatagatcattttaatttcattaataataaaccacatttaaaaaaccctcaatgatggtggtatatcaaaggaatacaggagccaacagaaagaactcccagtggccaaaactagaacaatttgtgcaataaaataaacaaagtagtattgaattatatcccaaagtattaaattatttttaattctaaatgtatataaataattgcttaaataaatagggaagaatatacagtcctctagatacatattagtgaaatgaaaaattccagtcaaaatatagggctgatctgggaataacaagaagagctaatcctctgcattactcatagcaattttcttgcaatgctttgataaaatctaacagtcacacaactaggtacataaaaatgtttgacaaaattgaatatccacttattatgaaaactctcagcaaagtacaaataaaggcaattttcttatcctgataaagcacaaactgattcttaaattgtatagggcatggtaaaggggcaaaaattctaaaataattttgaaaatgacaaagttagaggaatcacactatctgatgttaagacttaagttacagtaatcaagatagtcatgcaggtcaatgtaacagaatagagaatccataaactgatgcccacatatatggtcaattgatctttgataaagatcaaagaacagatagaattttctttttaataaatggtgctggaataatttggcatcttatgtgaaaaataaacctctacttataactccctctttataaaaaattaaaaatggattatagacataaatgtaaaattataaaactttacaagataatctaggagaaaataaccatgactctgatttaggaaaatatttcatatattttgaagctctggtgtttggtccatatatgtttaaaactgttatgtcttcttggtgaactgattctattatcattatataatgcccttccttgtctcttataagagtttttcacttaaagtctattttggctgatagtataggcacccttctttctttttattactatttgcatagaatatattttgccgtatttccactatcaacctgtgcttgtacttagggttaaagtgagtttattatagacagaatagagttggatcctgtgtggattttttttaaaaaaatccattctgccaatctatatcttttggctgcagagtttaatctatttacatttaaagggaagaacttactattggcactctgctatttgttttctgtaggttttatagctttttatcattcatttcctattatcacatttttctgagactctgaagtacaccagattataggagcagaaaacagatcagtggtttctagaggttacatatcagtagagagtgcttacaaaggggattccagagagagttgttttgtggtgatgagactattctgtgttactgattgtagtggtagctacattacttcatgcatttggtaaaacttattgaactatatacaaaatataaaagtgaattatgccatgtgatattgtgatataataaaaattatgtatttggtctctgtccctgattcctgagacagagcttctaaaacccttgcagatagggatgctaggagtatcttttgttcttatatttggtctttgaccctggttcttgacacagagctccgaagaactttttaatttcctgagtgataggagtatctgatacagagctcctacatccccggaatatcctggattataggagcatctcttgctgtaatgaggtgactcttggtaggctcctggatagccttagaataggagctgattgccatgaaaaccagccatgtaattagaggatatgaacttttagccccaaccccttattccccaggaagaggaaaggggctgaaaatttagttgattaccaatggccaatgaggtaatcaatcatttctacataatgaagctttcataaaaccccaaaatcagtttggagagcttctgaattgctgaacacatggaggtacctgagggtggcataccagagagggcacggaagctccctacaccttctctcatgccttcagtgatgtccaagggagggaatacagtcatgggttcttagtttctgttcccagttgggccagtaaagccccttcctccttcctcttttctgcttatcactatagacagaaactaaaaaccatggcttcaggttgctaaaagtctaaagcaaaacaaaacaggacaacaacaacaacaacaacaacaacaacaacctcaacaaaataaggcaggttggacaagcttgccctatgcagcttctccacctaactgttcattactttccttagtaacatcctttgtaataaatgagtaaatgtaaataatgtgtttccctgatttctgtgagccattctagcaaattaattgaacctaaacagggggtaatgggaacctccaatttatagccagttggccagaagtacaggtcacattctgggacctgcaattggcatctaaagtgaagggaagtcctgtgagactgtgcccttactgtgtgggatctgaccctatatccaagtagatagtgtcagaattgaattcaataataggccaacctggtggtgtctgctggagaattcctttgcatgcggggaaaaatccatacatattttggtgaccagaggtgaagtaatgtattgagtggtgagtgtgtgagactaagaaaaatagtttggtttttttatatctcaaatatattatatataaatttaaagacaaatttaaaaattgaatcattttaaaatgtctaaaatttaaagtacattgagtaacccatgagagtaatttataatgttcatatttgatgaaaatagtttccagtcaattatttttttctgtttacattatagaattatatttaggttaaattttatacatttaaaaattatttccttggtttatattctgaaatttttttctagtccttcttagagctgataagcatctttgctgattatctgcttgtgttactccatcaggcttccatagcccatctgattccaccagattattcaaatgagctccttatcacactgtagctcaagccctcagagatgttcttctctcctatacagacttgccacattttttcaggtgtgtaggcatttgctcatgtcttaaatgttcatctttatccatctgcctattcaaatccatctacacaatgtattctaggaagcatatcttgattatactatgcatcattgacttcctcatttagatgagcctctataacattcgtaggctgtattgcaaaattcaatgacaagtatatttatattctcttgcatttgtttcttgtgtttcaagtgtattagtcttgtcttctcagatagatggttaaggccatgatttatattttgatggttttcacagcaccatctttggtaaaatgactactgaaaatatatctttcatcaccatagatgctcagtgccattggattaatctagagctaaggatacttgtttttatctgaatctcagaggctggggacagttggtctcagaagtgacatgaatcactgaaagttaaatgttccttaacagagggaggttggaactcacatatttgaaaatagctcacatcatataccacagaaacgttatggtttatttacatacatatatatgacatatctcatatatataagacattttccaaatgtcttattcttacagtgatagatacttgttgcttcaaagaacatgtacactatagaaatatagaaattagcttaaattagtattgttactgattcacatcattttctcatttattgtcattgaaattggccccctggaagaataatcagtccaccatcttggaccagcacttaattattatttagcaaaatttaattgttattaccaaaatgtagggacaagtaaaaatataattcactattatgataatattggtaaatattctgattcaaatgtttttcttgcaatatgcctcaatttatcatcataaaaataaaagatccaagtttccagattgaaaatatttgatatttgtaaactatgtacccaacaaaaaacaaatatccagaatttataaagaacttaaacaaatcaacagaaaacccaaataacctcattaaaaagtgggcaaaaggaacagacatttctcaaaagaagacatacaagtggccaagaagcatatgaaaaaaatgctcaacatcgttaattatcaaaaagatgcaatgagatattatctcacaccagtcagaatggctcttattaaaaagtcaaaaaacaacagatattggcatggctgtagagaaagggaatacttataaactgttggagagaatgtaaattaatttggctcctgtggaaagcagtttgatgatttctcagagaactaaaaataaaactactatttgacccagcaatcccattactaggtagctacccaaagaaaaataaattattcttccaaaaagacacctgcactcatatgtttatcaaaatactattcacaatggcaaagacatggaatcaacctaggtgcccatcaacaatggactggataaagaaaatgtggtacatatatacggtggaatactgcacagccataaaaagaacaaaatcatgtcctttgcagcaacatgaatgcagctggggaccacttcctaagcaaattaaagcagaaacagaaaaacaaacactgcatattctcacttataagtgggagctaaacactggaaaatatagataggaacagtagacaccggggactccaaaaatagggtgggagaaaaagcagcagggtttgaatactaccaattaggtactatgtttagtattgggtaagggaatcaatagaagcccaaaccttagcaccatgcaatacacccatgtaacaaacccgcacatgtagcccctgaatctgaaataaaagatttttaagagtaagaaataaaattatttgaaggaaactgacctatacatttctttacttgccttaaatatctcttctttgaggaatctgatattttttgcgtataagtgctcttcagcaattagttgaaaatacaaaaccacatagtttgcatgatatatcaatttgtgtcacttttttttcaattctttgcaaataagcactccccaaattattagaaatctcagaaggaaaattaatttattgctgcagcatatattaggcaaagtggagaagtggagtattccaactgaactaaaaagtatatcaaaccaatttctagctcccactgaaacattaaaagaattaaacattacaacttactactgtcaatgtaattttgttcacttccacttgtttttctgcagttttttcaaaaattttaacactgaaaacattataaaaatcatataactaattgtatgttggttaaaatatgttttatcataataactactttcacgtactaatgtttgatatggtttggctctgtgtctccacccaagtctcatatcgaattgtaatccacaatgttggaggaggtgattgaatcatgggagcagacttccctcttgctattgctattctcattatagtgagttctcaagagacctgatggttgtaaaagtgtatagcacctcccagctctctctttcctaccagtcatgtgaagatgtgcctgtttcccctttgcattttgccatgattttaagtttcctgaggcctccccagcaatgcctcctgtacagcctgtggaactgtgagtcaatgaaacctcttttcttcatatattaccaagtcgtaggcatgtgtttatagcagtgtgagaacagactaatacaatattattatttcctcttgaattgtgcattgtcatattaaaaatttcaagcattgttctaggtgctggcagcagtgaattaaaccaaatccctgtgctaaatccatttatatttgatgggggagagagaatgcttgccaatctttcttcctaggtacgtggccctcttattcttgatgctcttgtgaacatgtgatgtggctctttcactgagaaatctccatggggaagaactgggtattacataaggcacttgtaacatcagtacaatctaggaaaaagaaatcttaagatttgttttagatttgaatcctaaaatttccaaagacattcttctatattgtgagttgttagagttctttaaattgcacttttgactatagaaagtggattgccatgttaaattaaaacaaaaataaaagatcagcaataaataaactgaaactgattacaacattttattatagttgtatttttctgggaaaggcagaatgaacatcggatcccccaaagggcccattatctaaagtgtataagggagcacttttattgtctcacatagttcaagtggagatattggcaattccaaattcatatgtaaagcccagagtcagtctcataccaaggtctgctcttaacatggcagagatactccatatgccagggttactttgatttaataccagctcatcattcttttgacttttccagatggcagacttttagcatagatattttttctagatatctacaattgtagctacatggagtaaagtgcaattaactgaaattactagcaattttgtctttctgatttaaaggcattttgtttattctttttaagtactccaggcccctgctcacactcatttgttgaattcagtaactaaccaactcttctgaaaatgggaatataaaattggaattcctcaaaggttatgtaaaataatgtatgaaaaaccttgtaccacagaatttggctgttgacatgcctttaataaattttgggtgtatctgagcacatcacttcatagtaagaacatttctatttacaagcagtaatgtatcaaggctaaagttacaaatttggtctatggtataagtctcataaagtttttgccatgttgaatttttttaaatgatgttggttttgtcagttcatgatagtttattttttaaatgttttaccaaaatggtcaaaatatcttacatttaaatgtttattctgttataaatagtagacttatggatttcttaaatatttgttgtaagcatctagtgaggcagtcgtaatcccactaactatatacaaaccaaaaagccctttttatgtttaaaacacacacgctgtgaaggaagttattccaaaaactccagactgtgaacagacattaaccttctactttgacaacatctaattttcctgaagaacaattaaaacccagggagcctcaattagaagcactttcactttggtaataaaggccaagttttaatgtttaggttttagttgcattcatttttcataccaatgaactgcatcatgctcttccttcagcacacaagctgcaaccaggccacaattttatcattttcatcagggcccaaacatatgccatctctactcaaagccctgctaattcctggaggtttcttcagagagctgagttgaggagagaattattcagcaaaggtaactaacatggatgctaatgtatataatctggctgagaaatcagcttttcttcaacagctaactgtgccttattctttctggtcactttctccaagaggagcactggactctgctagtggatctaaagttttccctagtgtattttccagccatattctagagatgtgccccttctcctgaactgtgtggtgtggtgaaggtggggacatgatgaggacttagctctcagagttagcaatgctgcatgcatccaggatctgctactcactgggggaccttctacaagtcactcagcctctctggtcctgtttcattatctatacaatgaggaaccctgtctacattctctctaactatcatatagctccaaagtttctatgaagcccagatgttccactcaaggaatttagtatctttacaccttcattttcaagaaaaaatgaagcttctcctcccaaaatattagaaaccagtgctaaaagtctagaatattttagtgtctatgaattttaaaatcctgttttaattacaaaataataatcagaagagtaggaaggagacaagttaataaacaagcaaaagctttttccctaacaaataatcagccaaggaagagatgaacataagaattgacatagttaattctcctagaatgaatatagtgcaggagttactccatgatatagaaaataaggtataaccccaagctgtcatttgaggaccaataagtcattgaatgacactttgattcctagatgcaaatattttaaagacttttttattaatacaaaattgtggattgaggcatcactgagaatcccaagtaatgagcatccacagccatgtctctctcaatatgcaccatgcgggtctgggtccttctcagggtccaggcagggtatactatttatgctcccctatgtctgctcttcttctgcaggaggcatttttcccaccttcatagctgtctccgttctcttctactttacagtttacaggaaagctacttgctgtaagtcagcctgttttagcccttgagatgcaaagagctttgcatgtgaagctctatatgcaaagctatggaatgtggcactccatttctctgtcagtaaaatctatcttgaaagtcttttgttcaggactcagaaatatgattttacaaaataaaagtagaacactgactttaatggaataaaataatataccagaaaaaaaaactctctctacattttatcccttttgcacaagtaatgcccagtggagtcagtcccctgccccaaggcctcactgataactcttttcccccattaagcttagccttcctttctaagaaatatcctctccttaagcctaaatctgaatgctatttcaaccagattttactttggtaaaaattataccaacagagatccgagtgccattctcctccaaagtaccacaaaatccaaggataacaaggagtgcttactacgtgacagaggaagtactaagttctctgcttgtattgactcatgtaaccctctcaaaagccctatgtgttaagtttcccatttaatgaatggaaaactgagtcctagaaagattaattggctacctaagagcatacagttagaaagggtggatctgggatttcaccagatgcacatgtggctttgtgaaatctgacagggatgtcaatatcccgacaggtaaagtgaggttataattttctcttattttctattctttttctaaaaatcatgtgctcaaatcttacaggactgtgtactcaagaggctagctattattctccactgctttttaagcagcaaaatctttttcattaaatgacatcttaagtaaaagcttaatatatacaacatgtcaaacaggggttgctgtattagaggtgaggtatggatgtgctggctgcaggtgagggcaaagggcaaagggcaaaagggcaaagggcaaagcccgagttaccttcttcaaggcaactctgccacaacttgaaaacatcttaggcctcagtttgaaatgcttctcctactttcaggagtcttcagcatcaaaatttctcccagataacctgacaaaactgtagaacatcagacctggaatgactgaaagaccaccgggctcagtgtttacctgaggtgggcaagtggctgagcagctcaggagtgggcccccttagtcttgtcccatcttactttgtactacactgttctttagagaaagcttccttttggagaccaaccaggactccttagaagcagaggtgacaaagcaagctttctaaatgatttgggggaaaagacaagtcttcctttcacatttttggaaggaaatacttttaataaggcagggattctccaatgaactggtctaaaccactgcttgcggcctcatgcctggcctgcttcacccactcaacagaatcacctcgtctctgaaggtggttgtgtttgaaacacgtgctttatggagcagctgcttacaggcttaaaagggaatcagaggtgtcggttcaatcaatctgcccccctgtaagcttcatgaggacaatgactctgtctccctgatgcacgtgaacctagcaccggcaccctggagcagagcaagtgctcaatactgatcgtgtttgcttaattgataagccattagtgtgcgctctaataaactgctttagaagaatgctttaggagttggaagtatagatctgcctaacatacacttagaaaaaattaggcagatcttttaaatgcttacattttagtaaggaaaacaattgatcattagggtgaacgctgcatcattattttacaatctacaaagtaacaggaaagtgtacagatttggcaaaccacagaattaaccattgtatctgacttacattactcatttgctcatggatgagattctaacagagatgcatttggcattttcacaaatgctctgcgtttcaaagagtagatcagctaattttgcgctgaaacccttaaacttaatggggacaatgtatctcacctcaaatcttcaatcagatgtgctgatcaaacccacatgaagcacatttattcttggaaaatattttcagttttactatttactattgtaattcccattcataaaatagccagcatttgccattatattttacagagacatctttaacaactttttacaagaatgactgcaatattttaggttatcaataaactggtgtggaaaatgcagcattcttaaaagttagtcatggcactagtgcattaattatacattagaacaattagccttaaagagattatagatttataaattgtaaattatgccaagtattttgaaattaggtacctgtgagttatgaccctgtgttttgaaagaacaacttgtaactatattgctgatatcttgattataatattttatgccaacattatgttaaaatataatatcccattataaaagttccagagacaagccacaatatgtaaatatttctgtattttaatttacagagcttattttttcatttgccctgataactgaattaacattgtcaagggaaattcatatgaatcaaaaaatgcaataaattagacccttaaaataattcatagttcatgagttgcccattttaaggtcaaagtttttagcaaaagctcacaactcttatggcactatcttttaggtacagtttaaaactttgaatatgctttgttttcaagtgtttatgaataatttcttcaataataaaaaaaatcatatactttgaagaaagggcctatctcattcttcttgcctggccacatggtctcatgggtacaattcaatattttaataatttctactattcctgagatagtcaaacaatttctcatcatcatctcaccatcacaatcttaatgacaagtctcagtttctgagtgtcagccagagagcagataccaggaattgtgctctaatcctcataacaaaacttcaagatctctcggcaaagaaaagtcaaaccaagattcaaaaccatggttgtggattccaaagctgaaccctttctggccatgatgcctcctttagccaagtggtaattcaacagttagctttataatatgtcacagatagatgatccattaaatagtttctaacactgttctgattcatctcttttacaatatattgagaataatagcatttccacaaaggttatttcaaatgaaaagacatttactatctttgtgctatcatttaccctaaagaacctatatttttccaataatgtagtttccactcctgggaaagcacagctcttttatacaaatggcatgaaatcagagggatgctgtgcaaatgctgtgcttctccaaaatgaatttttaagattgaccccaaaactcatcttctcctttcaatttacgtaatatctcttacaaaactgccaaaaccatatttcaaatttaaaaagtcttggacaaagggaaaaatgctctgaaatatcaaattacatgtactttatttctttcactgtgacgactccaaaatataacctcagcttcagctatgatttctcttaaaaattctattaaaatgcaaagaaatagttggttgtaggtggcagagccttctgagatccctctggcagtttgaaaatatgcccttaagttctttaacacttatttaaaaatagagtctaatttccctctctttgaatatgagccagatttactggctcacttctaatgactgtaatatggtagaaatgacaccatgtgacttcctcagctcagttaggaaaggccagacacctatgcctggctcccttctgctctcctggtacactcaccattggatccatctactatgctgagaggaagctgaagagccatatggaaatccaacagctagtatcaaccactagatgtgtgagtggatgagcctgcagatgatcctcgcccctggtctttgagccatccccaaaccatgcggagttattgcatattcataaacaaaataaatgctgtcattttttaagccactaaattttgggtggttgttctgtggaaatagatagtcagagcaagcccattcaaccatttgttttggggttccaaatagaaagcatcttgaataacgtagattaaataacagtaaatgcaaatgcagacaccaaacatatcctagaggaatcttggagaactttagtcttgctgctttttatttttacatctcatcagcagtactgacgtttcatcaggatcaatggagaattaacaatggagttaatattttttccctttattagtttggggaaaaggtagatctcataatctggtgtactccttttggaagcttttcatattatcctatcctttatcacaggctcctcacattcagcatgtcctaaaccaaatattttttctcctacccattgactcctccccctatgattctcatcattatcaatggaatttgacttagaaatctattcctttctcttctccttccctatagtcaatcattaaatcttgtagatattatctcctatcactgatcatttgatataactcaccaagtttcactaataataatcaaagtggtaatacatttgacaaactccaaaaaaagataatttttttctttttctttttatatggggtctcgctctatctctcagtctggagtgcaatggcatgatcttggctcattgcaacttctgcctctggggttcaagcgattctcctgactcagcatcccaagcagctgggactacaggcatgcgccatcacgcccggctaatgtttttcgtacttttactagagacagggtttcactatattggctaggctggtctcaaattcctgacctcaagcaatctgccagtctcagcctcccaaagtgctggattacagctgtgagccaccatgccaagccaaagaaagatagatttttaaaatgtttctaataatagagaaagtaaagatgctacgttagaacacattatctgttccccttcccgaaacagcgaattattgtttcggtttgtgaaaatatccaaatgcacagtacatagaaaactgcaatgacttcctttaatgtgtactcatagaaactcaagatcaggagtgacttctccaagaccccacattcgcctgcttcctttgcgcccctctcaggtgcatattttctgtttttttttttttttttcataactcttttcaggcatggtccctctgtttatattttcaaagacgcttagccaggttaatatcctgtcagtcttttcacacactagaagttagcctgttcatatacgggccaatggatcagaaaatcagggaagaatccaaggaaatcaaatcaccatgtgtagttaataaactcgtatttattgcttatctatcagcagatgcttctaaaaacatccatgcccaggccccaccacagtcccattaaattagtgtctgggggaagggctcaggcctcagtatgtccagagctctcctggtgatgccagtgagcagccagggccgagaaccactaaccagggtgtgcctactattacgaaggtgttttcagagatacacagaaagcacctcagataaattctgtaaacatctctgtaattgaaaaaagttataatatgtgagagggagaacactaattcaactcattttttactaactggaccaattattttaccaaaacaagtgtatattgtaggctttgtcgtaaggtttctgtattgaaagaatgtagagcatctgtgagacggaatgtgttttgggttttggtgggtgtggagtctaacctaaccaatattttgagtaaaatgttagagaatggagacactgatctttgtttaaatcttattttctccattcattgatgtgctggagataacaagccacagctgatgaggacctaatattgccctcgtgagcacagaccttctgctgttttctacaacaaagaaaacagtatctctgcatcattgttcaggcttccagcagaaaaggtgcaggcatgagttcagagaagcactactagtgaagctggggcgccccacagcgccccccgacagaggggtgagatgatttgtggatgctctacactgcgtgactaaaacatttggaggctcgctattactttgcctttcattcccttgtaggaaactatagattcaaatgggttggtatggctggttaattttaatttataactctatgtttatttaaaaattggataaaattcatgctgactgtattttattatatacaaacatatccatgcttacttccatttatccatacaacaaattctactcatagtatctatttaactcgtactattagaaatgatgaaataaaattgttacttaaattttatttaaatctaataagatatattcagtattgtttagctcataattgtatagaaatgaatgtatacatttatatattttttcttgaataatcaagaggaaagacattctctgctataatatgaagtgtcaaaggtgattgttgcaccaggcacggtgtggctcacacctgtaatcccagcacttcaggaggccgaggtgggcggatcattgagatctggagttggagaccaccagcctgacgaacatggtgaaaccccatctctactaaaaatacaaaaatattagctgggcgtggtggtgcactcctgtaatcccagctactcgggaggctgaggcaggagaatcgcttgaacctaggaggtggaggttgcagtgagccgagatcgcaccactgcactccagcctgggcaacagagtgagactctgtctcaaaaaaaaaaaaaaaaaagatttcgtataatgggcagctgcttttacctggaacgcaataaatcctcacatactttctgaaaactgactttgagattctgtcttaaaaaaaaaaggtgattgttggggatataaatagtctatttgttcctataaaaaaaaatctttcgtaaatcccctggcatataggaaaggtagaggaaatgctggtgtaccaggcctcatgggtaactctcccatttcctcagggtgctccaccgccaataccctctcggagagccatgagcgcaatgctgactcccgttctgccctcgctggcccccgtgccagatctccatgcggcttctggttgtttccattgcccgttctgatgtgggaagttgcttatttccaacatggagggaaaaaaagcccttatagccccactatacattaggctttaattagcaattaccaccctaatgaaaagaatcagcaacactttttacaatgccctgaggtgttgttggtgagaatttttcttttagactactaccacaaatacaactttttgactcagagatgtagtggttttagaatttaagatttgactgccatgcagttgattatcaaatgtacttactatatttaaacacaatctcaaattctgttttgttttgttttgttttgagaccgagtctcactctgtggcccaggctggaggagtgcagtggcgctatcttggctcacagcaacctccatctcccaggttcaagcgattctcctgcctcagcctcccaagtagctgggattacaggcgtgagccaccatgcccggtccacaatcccaaattcttacttgggatattatattcaaagaaatataaagtggccgagcacggtggctcacgcctgtaatcccagcactctgggaggctgaggtgggccaatcatgaggtcaggagttcgagaccatcctgaccaacatggtgaaactccatctctactaaaaacacaaaaattatccgggcgtggtgacacatgcctgtaatcccagctactcaggaggctgaggcaggagaatcacttgaaccgggaggcagaggttgcagtgagcttcgactgtgccactgcaccccagcctgggcgacagagcgagactgcatctcaaaaaaagaaaaaaaaaagaaagaagaaatataaagtgataccttgttaagtaatatttccattatagtttctgtctgcaactacatgaagccctctgtgcccttgcagtaatggcatctaaatccagcaaacagagtcgcatcttctattaccaccatttccccgatggattcttccagggaatggaggcacaagtcagcttcatgcctggctgcatatggaagaaagcaattttcataaatcctcagctccatacaatgggaaaagctcatttagtttctgaggtaaattaatattttttgtctcacacttttttctattttcttttgtttttataattatcatacagtaaaattgacctttttgtggtgcacatttctataaattctaagacatatatataacgatcaccacaataagatacatttctatcaccctaaaaaaattcccacatgctgcctctttatcaaagcctcccttatgccaccaagcactggcaatcaccgatctattttctatccctatagttttatcttttgagaatgtcatataatggaatcaatacagtatgaactttttgaatgactttgttcactcaccataacgccactgagatttatccaagttgttgcatgagtcgatagtttcaagaaaatgtctactattttcctgccaagggacaggtttccttgggcacatcctagactcaaagaaatcattaaaaaattcaatatcttattatctttatgtcaactagattaccagacagaattttctttgttaaaggaatttctattctttgtttcttaaagtaactaattttggctaaaaaaaaaaaaaaaaaaatctgctcctggatttcacaggatgaaatctggcttaaatgcactaaatcaccttgtgactccttagttctcatgacttctaagagcaaaagacattttccctactgcatgcagccaactctacaaatattaaaatctagaacctaatgtagtggaataaattcatatgaaagctacagaatgcactgaactttcagctaatgcagagttcaaataagaattccctctttaatgtcataatacaaaacgttcacatcagttaagtattgattacaaacatctattttaacaatttggtccctggaaactaccttacagcatggttcttgcaaatgttacttcaaattaaagttaaatgttaaatattatatatatggagaaagagagattcttttttcagaaaaatacccttcaaactaattttaatgcgaacaccacattttaaccaaaaaaattatcttcagttttccatttatttggcatatatggcagacaaaaaaacaataaatttatttttctaaagacaggtatgttatatgtgtcatgtgtatcgtatgttaagttgattttaataagtctgtgtaaagaaatttattgagataagcatttggtgagcatgtgtttcttcttaactggtcactttctgttggtaagcgggtatctaactgcaaacgacaactttactatgcaaggcaccaacctcacttgggagcttgtttgaaatgcagacttccctacttacacctacgttgacttggaatctgcatttaacatgatcataaggatcttgcacattacaatttgagaagcactgccctaaaacatcttacgaataaaaccggaacactttcactgcaaatgtgctatttacattagcatgactactgtggaaaaaaatccactaagcttgaattttgaactagttgaaagcagattgtgataatgtaagactgttttgagaaatgcaagcactaactatcccttagcaaatataaagatgccacatgtggtctaatgtaatattagaccttccgtcttctcaggaggcagagccattatgttccaacctgagcctctgagctaccattacttgtttctattcttagccttcatgaatacaggtcacttattgggattatactattctaacaaaaaaaaaatgtgttttccaatgggaactacaacaaaaatagatgaattccttaagaaacaaatttttattcctaaacaaatataatcatatttgtaagacataagaataaatgaaaaaaattagtaattaggtaaagagtacatttattttcaaattctgtagttcccctcaagataccactattgacgtggttgcaaagcattatttgcaattgttatgtcaaagtcgtgttgtgtctaaagaaagactacctgactcttgtttccaaattgttccacttatacaatttgtgcttttcctagtgtcaaaggctttccagccagaatgattccatcttgagtgaaggctaagaaaataaggctgggacttgctgggctgcattcatagaaagttaggcattcctagcctctagatgtttactgctaagagaacagattgataatgtttactaaacaggcccagacttgggattgtcttgatatcctgatatcttgagaacagaagcattcctaattttgctttaaagataataatatcgatccttgcaaaacataagaaaattaatcctttatcacaaacccttgtagcatagcacatcttcccatgatctttatttatcctatatataaacaagcgttgtacctagggtggacgcgttcctcttcttccttttgggaactcctggctctgtctatggagtagctgttctttcgccactttactttcttaataaatttgcttttgctttgcaccgtggactggccctgaattctttctttcacgagatccaagaaccctctcttggggtctgtatagggacccctttcttgtaacactagcaaggaagtcccttccagagagctctctctggtttagcagcacacttatattggtgcaggatgggaacattccataaagacatattcacatttgttcaaagtcttctgcatcaactacccccagactttgatgtattctgcctttaaaatcacgctatgtcccagtcactttttgttgccttcccttccaatccagttgaggaatccctccgggaaagtaaaatctgtctacttgtgctctccgtccacctcctggcatctcctgtcaactatttccctactctcttgttctttcaataattcccatcctactggaactttctatcaacgtttcaaattgttatctaaatgtcacttatctgaaaacaaataaatcgcctttctttttctttcttttttttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaacgcctttcatgactctatttcaaactttttttttttttttttgagacggtcggagtcttgctcagtcacccaggctggagtgcagtggtgtgatcgtggctcactgcaagctccgcctcctgggttcacggcattctcctgcctcagcctccggagtagctgggactacaggcacctgccaccacgcccggctaatttttctttttttttttttttttgtatttttagtagagacggggtttcaccgtgttagtcaggatggtctcaatctcctgacctcgtgatccacccacctcggcctcccaaagtgctgggattacaggcgtgaaccactgcacccagccgaccctatttcaatctttttagctttcactgaatgtttctctacctgtccgtgaatgaatggtctccctttattttccatttgtctttcacatattccaacttaacatttatttccacaactgacatttatttgataaaggtcctttgaatacattttagctctaatatgcctactctgtctttaatgtgtgacaatttcactaatggaaatacaatcatatgtgccctgtaaatctcccaagttgtctcaattctccaaagaattacatcatgtctgtccacacccaccaaacagaaaactgaaaagtgaccagttcagcttcaggctagtgttttttcattccaccaaagccacattatatttaattaacgaaactaatgcctataaagttaacaataaaggaatataacacatatacctgaatatacctctattcaaaattattttccaagaatgaataaatgttcacattttattagagaaaatgaaacaatcataatatctgagatttatttcaaaactcttttttttactgacacatgttcttgtccacaggccaatggaaacagacatgtgtagcattatttagatgatcaactgcattaattcttcatatattagtcattgacaatagacctacaaagagagtatttctcatccttgatataaattacagttttcatcattgaatttacttactcaacagtttttagacacatgtgcttgtggacttatatggaattcctgaggttgaacttgctgtgtgataaatcttctagctttaaatacagagtctgtttaaacagggtgagttgtaaattatctgacaaggaaatggattttatgtggaaaatgcacattttctcacaggcagggcccatgaaactcatggtttgaatattttcagatagcagagcctttgacaagtaaaagaaacaagactattgtaaacactgagcttattcgaaaagcatttttttaaaatttccaagcttatcagattatgtctatataaaactaacatttttgtgaatttccaagtatgtatttggctcattcattgtttctttttgtccacagatgtacacatttttataatgattacaacaaaataatttaaaccatccagtaggtgaagcattccccttttcccaagacagttggataaaattgaatcaaaatttaattccatgtctgaaggaagtttaacaccctcctcggaagtcttgaagcctcccaggtacgactgagtaaagcagattgctctccacattgtaggtggacctcatatcgttccttgaaggcctgaatggaatgaaagtttgagtaataaataattgtttctctatgatagtctttgaacaggatatcagtgtccttctgcctttggactcagactgggactggaacttacaccatcagctttcctggtattcaggcctttggaattggggtggacctacattaccaacttccctgggtctctagcttgccaactgcaaattttggactcctcagtctctgtaatcacataaagcaatttcttacaataaatgtacctatgtgtccacatatccatctaagcatctagtgggttctgggtttttttcttttggaaggtacgtgactaatacagattagtactgagattagcgtgatttagtactaacagtggttctagagaaacaaaattttaagaataaatttcttgaatttgttctgaagtttccagaattggctttctaatctgattagaattaaagatgctagtggttctgtttccagtggtaaagaaagcactcacagtacctggcgtgatttggcaacagaaatatgcaaaatatcacccttggatagtcctaatcaactacttacaaaaagcatggatatggatgactgtgtatatggtactttcaaacatttccgacaagctattgaatataacagttcaggactgattgttcctaatggtgctggacaaagtatagaaagagaaagatgagcttaacgattaaaattcccagctcaaatgctacctaaatgatctgaaagcttctatgtgtgccctgaaggagacatttatctcctgtaatttcaggtctaagattgctgaaaatgaagcccagaaactcatcctgtgactggctgaattacaatgtaagtttgaactcccagccttgtagagtatttatggggaaagtgagggcattgattgggaaggaatggaatctgaatattggagtggggatgtgatgtgaaggaagacctggatgaagctggaaacactgaaccactaagttcttttctgctggaagatgtctccccagccccagggggagcagcctctctacccccatttgaagagagtaacctcttagtgactgatgaaattttagtggcctcccctgaggaagctgccatcaagaaaatgctgaatattctcaggaaccatgcctaccatctttctttgcttctggatctagaactagactcatctcagcgggcccctaaaggtgaggtataaagtgtggcccatgaggaggtgtgctacactctacaataattgtttgagtttttaaaattatacagacagaaacctaggaaacatgtgagaatggatattaagtgtgagagatattggtggaggaacaccaacttacctcaggctgaaattacttttactaagcatagattatacagttaatgtgcatctcaggagtcagaaagggctctaacactttctgtggttgactaaagcctagaccaaaaggtggcctacagtgagtaagttggaaatgccagacctgccttggttgaatgtatagatacccctctagttactataaggttacatcccaataaagctaccataacttgaaaatattgcaagtcaaactgcatttaatacacttaacctaccaaacatcatagcttagcctatcctactttaaacatgctcagaacacttactttattctatagttgagcaaaatcacctaacacaaagcctattttataataaagtaatgaatagctgacctaatttattgaataccatactgaaagtgaaaaacagaatacttgtatgggtactaaccattaatgtacacagctgaaagtgcgcggagcctgaagaaaatttgaaacattgaactaaaattaattgctggctgatggagaggttatagtgacagggtcattggtttctctctcttctgatgaagcttgagaatgcaaaatgatacaatggactttggggacttggggggaaaagtgggaggggggcaagggatgaaagactacaaatatggtacagtgtacactgcttgggtgatgtgtgcaccaacatctcacgaatcaccactaaggaacttactcatgtaaccaaataccacctgtacccccaataacttatgaaaaataagaaaaaattaaaacattaaaagtataaaaaataaaaaccactggcaacacagcacactcacagtacgcagctgagtattggtcatttacccttgtgatggtgtgggtggctgggatctgtggctccctgcagctgcccagcattgcaacagagtgttatacagcagatctaacctgggaaaagatcaagattcaaaattcaaagtgtggtttctactaaatgtgcgtcactttcacaccattgcaacaggaaccatcttaaaggggaccatctgtagaggaaagcattcaaaggcttagggagatcggaatgttagaatagatttgccatttcagatctaaccaccctcattgggagaaaacagaagatgtacttcttttcactgctattgtgagaaatcaatttgtaaggagagcctaagtgtctctgaagagctttgtgattgccagaccttacagtggagaatgcagtcactgtttggaaaatctagacaatgggagtaattggatcccaggatggcaggagccaaggggtggtaccaaagtgagagtgggtgtggttcctgtaagggaggcagactcaagacagcaatcagaatcatctcacttgtgcagatttatggtgttggttagttgagcatgatggttctagaggtgaaatactctggaagtctactaaattcttactttctctgtatacataaggctgttcttgcattgctataaagaaatagttgagactgggtaatttataaggaaagaagtttaattagctcatggttctacaaggaagcattagcactgacatctgtttctggggaggcctcaggatcatggtggaaggcaaagcaggagcttccatgtcacatggtgaaagctggagcaaaagagagagagttaggtgccacacttttaaacagccagatctcatgagaaggcacccactgtcatgagaacagcaccaagggaatggtgccaaaccattcatgagaactccacccccatgatccagtcatcttccaccaggccccacctccaatactggggattacagttcaacctgagatttggctggggatatatatccaaactgtatcactgggtaagcagaaaattcctaggtcaagtgaatataagtttaacctagaccagagtcacaactcctcaatcaattcccatattagagccagtttatagccccagaaccccctggaggggaggccaagtactcttgaggaaggagcaccatacactgcaaaaataattacactgttaaacttcctcacaacttccccaaaagtaaggtaccatttagcagggtaactatgcaacggggaaaaggaaataatcagacctattagaaactactggacactggccctgaactgacactaattccaggagacctaaaccccctctgtgggtcaccagtcaaagtaaggacttatggagatcaggtgattcagggagttttatcccatgtctgtctcacagtggtcccagtgagtcccgaaatccatcctgtggttatttcttgtttccagaatgcatgattagaatagatatactcagaagctggaagaaccctacattggttccttaacttgtgtaagggacaagggttattatggtgagataggctaaatggaagccgctagaactgtctctgccttggaaagtagtaaatcaaagttagtactgcattcctggagaggttgcaaacattaatgctaccattaaggttttgaaatatgcaagggtggtgattcccaccacatcccccattcaattcacctatttgaactgtgcagaaaacaaatgaattttggagaatgacagattacagtaagcttaactagatagtaactccaattgcagctgctgtatcagatgtggtttcattgaataaattaacacatcctctgatatgcagccattgacatgacaaatgctttttttcctctgtatctgttcataagtctcattacaagcaattttctttcagcagacaaggccagcaatccatcttcgctatcctgcctcacagatatgtcaactttctaggccgatgttaaaatttagttggcagggatcttgattaccttttacttccacaagatattactggtccgttacactgatggcattactggtaagacatacatgtcagggagtggttaataaatccaactaaaatgctggggccttctacctcagtacaatttcgagaggtctagtgatgttgggcacatcaagatattccttttaaggtgatgttgcttctggtctctcctacaacgaaaaaaagagactcaacactctgtggacctctttggattttggaggcatcatactcctcatttgcgtgtgttactctgacccatctactgagtgacctagaaaactgctgcttttgagtgggacccagaataagagaaggctctgtagcagtccaggctgctgtgcaagcttctctgctgcttgggccgtatgatctagcagatccaatggtgcttgaagtgccagtggcagataggatggtgtttggagactttgacaagccctataagtgagtaacagcacagggccttagaatattggagcaaagtcctgccatcttctgtgaataactcctctccttttgagaaacaactcttggcctgctactagaccttagtagatacagaactcgtaaccctgggccaccaagttgccatgtgatctgagctgcatgtgatgagctgggtgttatctgattcaccaagctatgaagctaggcatgcagaggagcactccagcatttaatggaagtggtatacacatgattaggtctgagcaggctctgaggcacaagtaagttacatgaaaaagtgacccaaaagcccatggtccccacatctgctacactgacctttctctcgcagcctgcacttatggtcccatggggagctccccattatcagttgactaaagaagagaagacttgggcctggattacagagggttttgcataatattcaggaatcatctgaaagtggatagctgcagcactgtagcccctctctgggacatccctggacagtggtgaagagaagttgtcccagtggactcaacttcaaatagtgcaccaggttgttcactttgcttggaaagaacaaatggcataatgtgtaaacataattagaagattggtgacaaggaaacctgggaaagaggtatgtgtgggtggacctctctgaatgagtgacaaaaccatggtgatatttgtgtcccatgtggatgctcaccaaaggatgacctcagcagagaagaattttaaaaatcaagtggataggatgacccattctgtggatacctatcagcctctttcgccagccacttctgtcatctcccagtagactcaggaacaaagtatccatagtggcaggatggagacttagcctacatggactcccactcaccaaggtcaacctggccatggccactgtgacggtccagtatgcttgcaacgcagaccaactctgaatccttgatatgaacctggggtaataagccagctacctggtgacagattgattacattgggccactttcatcatggaaagggcagtgttttattcttactggaacagacactctggatatagaattgccttccctacatgcaatgtttctacccaagctaccatccatgggcttacagaatgctttaaccacagtcattgttttccatacagcagtgcttctgatcagggaattcagttaacagcaaaagaagtgcagcaatgggtccatgttcatggaattcatcgactttactatgtttcctaccatcctgaagtagctggtttggtagaatgatggaatggccttttgcagactcagttacagtgtcagccaggtggcagtactgagctggggaaagattcctcaggagtctgcatgctttaaatcagcatcgaaaatatgatgctgtttctccaaaaggcagaattcacaggtccaggaatcaagggaagaaagtgggagtggtctcactcaccgttattcctagtgacctactagcaaaatgtttgcctcttgatcctacaactttatgatctgctggcctagaagtctgtttcaaatgaaggattgcttccaccaagagacacaacaatgcctttatagaactggaaattaaaactgttacccagtggctttggattcctcatgcctgtaaatcaacaggcaaggaagagagttactgggctagttctggttattgatcttaactggcaaggggaacttggactcgtacttccaaatggagataaggaagggtgtgtctgcaatatatatacccttagggtgtccttgggattataatattctgtaattatggtcaatggaaaatgacaaccacctaatccaggcaggacaactaatggcccagacccttcaggaatgaagccttgggtcatcccaacaaggaaataatcacgaccagctgaggtgcttagtggaagaagtgaggtgcttagtggaagaaggtagctataaataccagctatgaccacatgaccagttacagaaatcaagattgaaattgttatcagcatttcctccttttttgttatgaatacatacaaatgtgtgtgggtgcattaagcaaatattattgtttttctgctgtcttattcccttataagggatgtattgactatatcattgcatttaagtgttgttgattttatattataacatttaagttgcaggatatcaaggagaaaagtaaacatcattcgaggattatacctccttttctggggaaggggtaggtgtgtcttcagtggtacatgggatgatgatatattagacagaagcatggccttgctattttctttatttggagattaagtatagtttaaggagatgtgtatggatgccaagttgacaagaggtggactcgcgatgaataatttcatgtggaaatttgactatgtcatgaggtgcccagatgtttaatgaaacattatcccagctatgtctgtgatggtgcttttggatgaaattaacatttgaatcagtagactgagtaaagcgagcttctctccctaatgtgagtagtccttactccatcagttgaaggcctgaatagaactaaaattactctgaccttccagtaagaaagagaaaactcctgcctgactgtttgaactgggtcatgacttttttcttgtcttcagactaaactgaaatattggctcttcttggattttgagcctgccagttttcagactggaacttccaccattgactctcgtggtgctcaggccttcagactcagactggaactctcccattggctctcctgggtctccagcttgccaactgcgaacttgacttctcagcctccagaattacataagctaattacctatagtaagtctttctcgctctccctctgtctctgctattggttctgtttctcaggatattccagatagtacagtcacctctggctgagaattccaacttcttcactttatagattattctttctctatgattcaaacatcctatctcataaataagatttattttctccctcaattttcaccaaaaaaagacacatatacatgtaacccattagtttattttcaataaccttacagaagatatggaggtgtaacaaaaattactgtaaacataagccttatattctttctttttgttttgttttgttttttttgagatggagtttcactcttgttgcccaggctggagtgcagtggcgcaatcttggctcaccacaacctccacctcccgggttgaagctattctcctgcctcagcctcctgagtagccgggattacaagcatgtgccattacatctggctaattttgtatttttagtagagatgggtttctccacgttggtcaggctggtctcgaactcccgacctcaggtgatccacccgccttggcctcccaaagtgccgggattacaggtgtgagccactgcacccaggccaagccttatattctttaaaagttaattccccactgcttggccagctaattccctctgagcttctctagcatgatcctggctctccttcctgcatctccctccttcccgcatctccctccttcccctcccttctcttctgtcttttctcttctcaggagcaaaaactaaattggtctccttttctcacacaagatagttttggtgccccctttgctgctttaactcctgccaatgggcataactttgaagtttcaattttatcccaagcagctcatcaaactagtacttcaacattaggaattcttctgtaataggaattctagtgccagctattcaagttataaacatctcaatctctgtcacaatcaaaataactgccattgactgagaactcatgctccaatcactgttatgatgtgcttcactgacattctctcatgttcttacagaaacaccacatagtcatgctttttctaactgtggcagatgctgctgtgtttctaatcaatatccattttcttcttcttttaaattaaagggtgctgctccattcagtcccactttactaggcctctgcattgcacccccgcatactattgttggtagctaagggctcacaagtgccctgttctctcctgagcacttcttcagacttaagggagctgcctcgcctggacaacctgtagccagtgactgactgacacatggtataaagggctattcctctagcctcaacgtcaggccaactctgtaatgcaatccatgctccaaaactctgggtgtcaggctgagccagtcttgtgctgagatcatcctggcttagatagatctcatctttgtctcaccctacttactattcccctctcataaggttattctctcaagaaaagttgctcaataattgctattgcaggctctgcttctagagagccctacctgacagattgactgcgctgcagaaaaagcaatgaaggccattaacagaaggaaaccaattagggtatcactggagcctgggtgagtggcgacctaacaagagctcactccaaaatggtagcagtggacacagacaggagttggatcaaccagttcatttgttttccataatcatattttattttccttgtagcaattatcactctctgctattatagcattttgtgtcttttaaagtttctttgttttttgtttttgagatggagtcttgctgtgttgactaggctggagtgcagtggcatgatctccactcactgcaacctctgcctcccaggttcaagtgagtctcctgcctcagcctcccaagtagctgggattacaggcacgtgccaccacacccggctaatttttttaggggcgggtatgtctagtccagacagggtttcaccattttgcccaggctggtctcaaactcctgacctcaagcaatccacccacttctccctcccaaagtgttaggattacaggcatgagtcaccacgcctggtctcctttaaagtatttttaaatatttaccttgttaaaagtttttatcttcctttaaagagatataagaatgagggcctttcttaggtactatcatattctttctgcccctaaaacagtgctggcagacaattcatgcaaaatacatatttgtaaataagtgaatgaaaaatgaatggaagaaaagtgattgagattagcttgaggcctatgtgggattgagggagctgattaggttataagttgagagagatctagaaatatcaaaagaactctggagaatgatctgtttggtataataaattatatactgggaactcaggagagatactataaggcctaagacggtatttgggtgactaagcccttcactttaaaagctcagtgtagtactttatgcaaaaccttgaaacttaccgtatttctttttggcattttgggtgatgcttaagaatgttaaataatgaaagactctttgtgttacctgtactgtgtgtgtattagaattgtaacctatttcagttttcgtctcatcaccaacaagcttttcaaagtagtagaaactactttttcagaaggtgaagtaatgctgttttgtccagtgggtgattacttgctgtgaatacttagtgatcatcaggcttggaaacatgcgtaggtgtgtataataaatgagaccgctactacctgttaattgtactttataattgcagtttatctcctctgtacacctgcagagtcctggctcatatcacagagaaaaggtcgttactgtggcttgactgagagagctcatttattaaagctctaaggggttgtattatcaacttcatctcatgtctttctacattatctaatattctccattcagatgtacacaaaaaatatccatcttttaatgcgtaactgatgtacatatatgctgttatcgttattgttaaagaactttagttatttaaagttagtaaattaaagttattgttatggttatgctgttaagttattgatggttaaatcaacaacttttaggcaacaaattggttgatcgcttattgttgattttaggcagttgccaagcaatattaatgtcctaacattaagattaatggagtgtatcattcattgacttgatcatttccctcccatttctattgccctgtcccttggggtgctggcattgggttcgtatgtgtgcaatcgaatcttttccgtggcagatgctgaggagcaagtcctgacagtgaatagccatgtgtttagtcagctgtttacacaggctcaaggaaatgagaattttatggaaagttgataagacatctcactactttcaaattcattttagaaaagtatagtatgagaagaagagcttcgacaaatattgtgtctaaaaagctaaaaacatcctgatcttcgtaaccgagtggctaacaaataaagaaactcacacaacgctcagttaaaggagtcaaaataaactgtcatagaatacacatcatgatgaggtcttatttagcaatattatattccctttaactgcatttgtaatgttgacttaaatgggagaatactgcattcctttgccttttcctctctctgaaggttttgagagaagaaacagaagaagttgtagaaaatcaactctgcttccttttactaattgtgaatataagctcaccgtactctggagtgaaaataaaaacaatgttttagttgattgtatctaccaatgccatctactccacattcttgctttaattggtagcttattttaagaaaacactatgacttctttgtagaaaatgtactttaagatcccagaagcatttaattcctcaggaaaacttatcaggatgtcatataatgattaaaaagacgttcaaaatcagtaattttcatcagctgatctgctttcttggtattttatactgtaataccctttactatatgtgatctctgaatagataagtcagctttcaatgctcacagtttttaacatagagtattttttttaaactttgagtattttatagattagggacagtgactttcactgaatgaaactatacttacttctggtataaagagaatatatactcatctacacatgctccactttgcactacagctgaaggactctgaaagcacaccgctctgggttttagctccagggcatcccgtgggtgggtcactgagcaaaagcattataggacatcccgttctacaaggaatgaggacaaagcccaggcttttctagaaagttcctctatatatcaagatactgcattcttagcacattctacagttattctaaaactgtaagccaggaaatggggaaggggagaagaaagctgggtccgctgaggccatctaggggccagtcctcctccagaggccgttaaattggtccaggaaagagaaaaatatggctttgatcagggtggtgacaatggagttcttaatcagtggtagggtttttgataggttttgtaagtgtgatagaaccaataagatttctttctagactggatgtagagtgtgagagaagaagagtggtgatcccaaagtcattagcttgggcaccagatggaattgccatcaacggagattaaggaggaatgatttgtcccttaaattgcacagttgtagcaatagatgagtttactaggaaataaaacatgtgtttgcaaaggactggtctatttccttaagaaaacagaaactaggccgggcgcggtggctcacgcctgtaatcccagcactttgggaggccgaggcgggcggatcacgaggtcaggagatcgagaccatcctggctaacacggtgaaaccctgtctctactaaaaatacaaaaaattagctgggcgtcgtggcaggcgcctgtagtcccagctactcgggaggctgaggcaggagaatggcatgaacccgggaggcagagtttgcagtgagccaagatcgcgccactgcactccagcctgggtgagacaacgaaactccgtctcaaaaaaaaaaaaaaaaaaaaaagaagacagaaactaaaatattagtgctcattttatgcctgtctttgtcaaaacactaggacattaaataacatgtagggcaatacaaaccaaaaatgtaataagcatgcaatgcccatatcctccaccccagtaaaataattcatgtattcagcttgcatccaaattatttattattattattctgccaaagtgtttcacacaggttgccattttaaattttgtttttgatgaaatgtctgttgaaatgctcctttggagaaatgactgtactttctcttgattccttgactaaattttcacagaatcgtttgatcggaaactatatagaaatgtgttcactattatccattagagtttattaagcaatgaaagaaatgaaggcataaggataaaacgtctgctcaaatttctgagcagtcactttctcattagagctcttgtatttggggactctaatgtggaaataccgtgagaatttaaagaacaaatagtacatcctcctcccttagaaggtatcagaatttttaatttttatattatattgtattatattatattatattattattatattgtattatattatattatattatattattgtattatattattatattatattatattatattatattatattatattatattatattatattttaagacggactctagttctgtcacccaggctggagtgcagtggcgccatctgggctcactgcaagctccgcctcccaggttcacgccattctcctgcctcagcctcccatgtagctgggactacaggcgcccgccaccacgcccggctaaatttttttgtatttttagtagagacggggtttcaccgtgttagccaggatggtctcgatctcttgacctcgtgatctgcccgtctcagcctcccaaagtgctgggattacagctgtgagccattgcgcccagcccagaaattttttttaatggtgaatcttaaatggtgaatttagataataacctaagataattttgtagaaatgcaaaatttgcaaaataatttctgatcataaaaggaggataggtgaaagcttatcccaggtggtgtctgacctgctcttgtatgtctggattttcacactagagtgcaatgatgtggcatatccactctgatttttgcaagtttaagaagttactttagacacattgtaatgtttctttaagcatatttcactcccataaatggggtaacaacagtccatattaaagttagtaatatattacaattaaagtgtctaattctcagatcctttgtaacacatgggctacaataaatcacatacaaaaaaagtcttaaattattagaatctattatgtaaaaagtgactaagagaatcatgctagttttcaatttattgcctctgatctccaaatgcagtcttcaatacatgttctgtactaatggacatctttaagcatttctgcttaccagtaaggataccagtaagcagaaagaagactgttctgctctttccagctgctgcatggtgtgccagcagtgtgggtatgagaacatctggtgtcattctgccccagtgacatgttcaaaatacaccacccctcagtcctagcctgtcctagtgaccaccttcatgcagccctcttgagagagacgctatgtggtccaggtctcttgcccacactgccaccctgattccctctgcctgcttgtccctaccttccagacttgtcttgtgaggtccccccgatgcagcggccctcctctcagggttaccatatgctctaagctttgtgctgcactggcattgcagggaagtttacattttcccactgaagttttgataatgtaagcctatgaaacaaactgaaaataggcagattaacagaagaaaaggcatacaaatttattaacatgcatatgggcttgggtatcacatacaaagtattaataaactcagagcgagggtcagatggttgaagtttgtatgccatctcgaggctacagaaagaatggcagctcagagcatggccaaaaccaggttatggtggtgaatcaagttatggtggtgggacatgttatgggagggagagaagaggaggcctagcagcaaagctggtcttgttatgtagctgaaacctcacaggtagcagccatcacagaaaatagatggtaaatgtttctttgagaagtttaaaggtgtcagactagactcagatgaggaagggccccagagaaacctggctgtatcaaggcagattctctatggatgcaaacctccctcctgaggaaagacaacttttcagggctacttctatttgcagaccctctgaacagccatctcaaaagatgtcaaagaaggatatttgggggtgaaatgttttgattttcttcacaggcatacattttacatggcagaatcataataaagtataattaaataaaactaaagtacaagtataattaaagtgaatacctagtcctataacagatacattccacaaaaatgtaatgattaacaccaggggcagttatatttcaagctcatgcttctcagcttgtctgttcttgtagcagtgtaggtcaaatcagaagataaaaaccatagagtgatttcaacagaaatttaatataaagaattataccatgataaaagattaactataggatataagtgaactctataagttaatctagagctgagggaagatactcaaggaagaacgaacttggaaagagaagcccttccccaaagctgtagttaagactttattggagaaggtgttttatcctgctgaattacagagaagtctatctgtttacctgggtcagagcgggcctgcagtcacaggtgaagccgagctatggactgaattgcagcccgtcccaattcataggttaaatccctagctgccaatttggctacattggagatacagtcaaattgtaggttagggatttaacctatgaattcggacgagccgcaattcagtccatagctcagcttcacctgtgactgcggaccaggttaagccaagctatggactgaattgctatgacctgaattcatttagactacatttggaagtaattaaagtgacattaggtaattaaagttacaccccatcagattaggttgggcccctaatctgataggattggtggctttttatgaagcctataaaacaaactgattataggcagattttttaaaggcatatccatttattaatgtgcatatggatttgggactcatatgcaaagtatgaggctcaaagcaggggtcagatggttgaagttctctctccctctctctctctttctctctccttatacatacagttaaagaaggccatgtgagaacacagctagaaggtgaccatctacaagccaggaagagatctctcaccagaaaccaactggccaaaacaacataactttggacttcccagcctgctgaaccgtgagaaaataaatttctgtggtttaggccacctagtctatggtactttgttatggcagttcaaggaaacatatacaagcaggaaataactctctggaatgaggatggggtgcaggtaagcaatagcgagtggctgggtgcctgatatacaaaaggagtaaaggtatacaaacctttcctttgctaaaggaaatcaaaaatatttcaccccaaaacatagttctttgatgtgtcttgaggtggctattcagagggccagcagacaggaatagtgcagaaaagctgactttcgtggagtagatttgcatctgtgcagaaaatctatataggtgaaataaacagccaggctttctctgagattccccttctgcagcatggtatacaggcttctgaaccccactaaggtattgacaatcactctgtgattctctttgtgcacactaataaatttgcatgccatttctcctgttaatttaccttttttgagttgatttttcagcaaaccttcagagggcaaaggggaagcttttcattggcctctacacctggtttccacttgattaattggcctcctgaaactgcccagctgttcgaaatgatttatgcatctatgtggcatggatcacttcactatgtccagtactaacctaagcaatgcaggctcttgcccattcgaggtgagactctaataaagcatgaacattgtctaagccacctaaaactttcatagagaagatagtcgttgatttcacatattggttcacagaaaaaaagaatgggaccattatgtataattaaccttaccattattatcatctgagaagtctttttctatattttaaagtaaatgtcaatttagatagtgagaactataaactacattaagttgaaatgaaaatgctgaccatatgttaataacttcatgttaaggaaatatatgcactcgctgagaaagtctaccattttatgatatcatgagcaattaaatattttgaattatttttcattttatatatatactatttgcattttttggtttgcttataatattctctttatatacaacccccaaaataaaaataatttggaaagacatgaagaagatgctacctaccaccaagaaactaccaccaagatatcaaagataaacagaaccaatattttgctgagcagccttccatgtatttacatgtccatacacatggacttaggactaaataaattgtcactagtggaatcacactgaatccttgctagatcatgctaggccatgagtgaaggacttatatattgagaaataaagagaatcctaagccccccacttgactgaacagacttcctcttggtcaaagggaccagaggtttttaaggtttctctagagaatggctaacgaccattaggctttcttccctaagggtgaaggcagaaaccagccctttcaaaagtcttgcccagtgatttcagccaactgcctgacacttgtcctccctcttgcagctttaacacagaaactgaccagcattccttcccaataagagaccacccaccacagcatggctctggctggtctacaaaggctgtgtactaagtgccttcgtatcctccacttcaccttttgatgtacaaggcctaactgaaatacacttaaatgctatgtctccaccccaaagtgaacatgggacacatgttacatacatgttagcctttcttattcctccctccctggaagcacttattttctgctcagttcagaggttcagagtttctgcgtcctgcctgcgggttgtggtaacctgctttagaaatatagccctcttcccaaatatatgaaccatgattcttcaagtggacagaatgatttatggacttccataagcatgtgcatggtgggctcacagtacacatttctggaatcactgagtaaatgctatcgacaaactgtattttttcaggttaatattatgtcatggagacatcccaattcatcaaggtggctggctaagataacttaacaacaacacccaacttttgtaattagaaacacctagagacactagaaaatacataacaattctcctttccatactctgtatttagagttgggtgttgatagcattgcagatatcagagataaagcctttgacctttgtgatataatgaatgggaatacagatgcctgcacccagccagcacatagaaaatagggcacattcaaacagtagactgatttttttaaagagagaaaggatagggaactttgctattctctaggtgaaaacagaaatttctccttagaaataaagcactatacttattccttgcaggtatttagagactaaatatacataatcagctttgtaagtacttaaaatgcttaaaataatacattattataaagtaagaagtaataataaaattcacctttatgcatataaaaagcctcaatacatatgatgtaaaacttgacaaaatcatgataagtgaacagatattccagagagacagtttaaaatacctcactcactgtggggaggggacaagttatttaatggatgtagtttctgtttcacaagatgaaaaacttgtggagactggttgtgttctgaatgcgaatacacttaacactactgaattgtatttaaaaatggttaaaattgtcattttatgttgtattttgccacaattaaataatacttccctcagatactggttgagcaataaaccaaaaacaaaatctcaaaataaggatatttgaaaacactatttatgaaaattttatgaaaagggtattaacagatcataatactcaaaaatgacaaaaaatgctttcctttcaagttgatatgaaacacttataaaaattgcagtgtactaggccacagcaagtatcaataaataataatcatcgggccaggcgcagtggctcacgcctgtaatcccagaactttgggagggctaggtggtcagaacacgaggtcaggaaatcgagaccatcctggccaacatggtgaaaccctgtctctactaaaaatacaaaaattagctgggtgtggtgacacgtgcctgtaatcccagctactcaggaggctgaggcaggagaattgcttgaacccaggaggcagaggttgcagtgagctgagatggtgccattgcactccagcctggcaatagagtgagactccatctcaaaaaaaaaaagtaataataataattaatatgatcatattcttagaccacaatttgacaacatagattttgttaaccagaagatcacaatatactatactttgtgaaatttaaaaatacatttgaaataagaaaatgaagttatgtttagaacagaatggcaataaaaacactacatatcaaagcttgtatatgtttggtgcaactaaagcattctttagaaggtggtttgtatttgtaaatatatttattagtaaagagaaagcctaaaaaaatatcagtggggtaggtaactccatcagaagggagactccatacataagactacttacatgactacagagttatataagaaagacaaacagctcaaaatgtagaaatagccaaattataagggaacccagtgcatgagatgttctgtttcaggtccattgggaaagaatgggcaactctaaatattaatggtactgggacgttagttacagatgagaaaaaatataaaattggacccctacctgtcactggacacaaaaaaacaaatgtaagttctaatgagttaaaataaaaaataaaaaactttaaaattcagaaaatatgaagaaatagtttataccttccagtggacaaggatttcatacccaaaacacaaaactatgaagtaaaacattggttcattttacaacaataatattaacattttagtttatcaaaagactttataaaaagggaatagaagccattagcggaaaggagatgatttgcaacacctatgaaaaaggagtagtgtttatggaatatgaagaattcatacaaatcagaagagaaacgaatacaaaactggacaaaggaaacatataacctggcatttcataaacaaagaaaatcatattacttataaacttaacaaagatgctccacctccacatgtggaagtcaagaacaactgaagttcagcagaacaccctgaagtcaagattttgtcgtgtgtatgtgtgtgtgagaatgtgtgtatattttttatgttctgagtctgcatattttattgtatactttatggacattttcccatgtcattaagttaagagaaaagcattgatgactcattcaacatatatttagcgagttgttaccatgtgcagtatagttttctaattactggagctagatgaatgaacgaaataaaaacaaaaatctctgccttcatgaagattctattctgggaaaggcagaccataaacaagaaaaatatagtatattagacagtgatgagtgttaagaagcaaagtaaaatagaaggctaaaaagcattggtcgggggagtgaaaattttgaagttcaatatgtgagtaaagttctaactgaatcaatcagccatacataggaatattgtacaattcaatcatctctccatggttcaatatttaggtatttctatactttgacattgtaataaaagaaagtgaaaacactgtcacatgtctttgccagtgtctccaattattaccttagaaaggtttctttttttttttaatctttttaatttttttcttaagacagtcttactcttgtcgaccagtctgtaatgcagtggcatgatctgaaggaagttgccaatgacaataagacagttcactcaaatgttacctctagaggcagacagtaattcctgccacaaatatattttaaaatcctaaatttattgttaaagatctggtaatggttagcacagtaacagagatggaaggggaaagaaacatatcaatgagatgtttttctataaacaatatagacaaagagaatcaaatattctgttacattagacatcacagccactcatgtaatctcaatgtatggttctatacggaaagagcagctgatttcggaaaacacatccccccaaaaagctgtctaaagcagtagaaaggaaatctttgagccaccaagttgtaaactgaagagctccccaaaggctcatgacatacgatactgtatctggtcctaagtccagcagcttgccacctaaaagccagagtcaagacatggatgggtggaaggaaaaaatggttttaatcaaggtgtgagagcggcaggaaggaagataaagagagtggatgactgaagtatatttttaaaactgaggtccttagttacaataccgttgagagtgtgggggaataaggctggagggatgaccagcttcaaaggaggctgctcacagggtttcctatgtgagcgctgcaatctgcagttatgtaacttggaggattaagtggggctggaaacaggaggatttattgaatgtctgttttagtgttttaggagtggttgaagacggccccacatgtccatttctgtataaaggacaaaatattcattttccatagaggataaaacagagagtctctggactggagaccacggagaccaattgaggaaagggtacaatattgaaaacaaagtacacactgaaaattgagattcgcagcttttctcatttctagcttttaggatgctgacaacagggcttccttcctccaaaaagagaaataaataaatcaataaatattcatctgtggggattagaccaggtcagtaaaggtaagccaaaaaatcctgacattggtctggcacaggggctcacgcctataatcccagcactttgggaggctgaagcgggcggatcacgaggtcaagaaatcgagaccatcctggccaacatggtgaaaccccgtctctactaaaaatacaataattagttgggcatagtggcacgtgcctgtagtcctagctactcgggaggctgaggcaggagaatcacttgaacccgggaggtgaaggttgcagtgagccgagatcgcgccactgcactccagcctggtgacagagcgagactctgtttcaaaaaaaaaaaaaaatcctgacattaggcatttcccccaaaaatagatctaatagcaaaataatggtcctagtggtgagtttccaacactaaataactagagggatttcagggcaagcatgtggggctttgactagtaagtaaagactagtaagtaaaccctggatttaaatcacaatgtgagttctggagatctcacagtgtgagttctggagagctctgagcagtggagagatggaagaggcttcatgggagactcatccagccaggaaagagaactttagaaggttgagcctgaaagcagggagctcactgcggaggtgagaggggttgggggtcgggggggcaggggggagggaggggaggttggcattcagtccacagggctcctgggtttttctgaacctagagacttcctaaaatatttagtattcctgagattaatgtctattacctattttctgaatggcatgctttgtagttcttcttataggaaagttcttgttcattataagacaattacgaacttcctgaaactctaaagaaagctgaatgttgcaaagtaagctcacggctgaaaatactcttccattttcaacaaccttgttacaaaactcggcaaagagaagactcttagtgaacacacaaaggggacctgaatcaggagaagctcaggctctcccaggagctcccctaaagggtttaggtgcgtctcagaggagcttccacaaaatggagttctcctggaaacaatcactgactagttgttttctcttaaaatatcaatttcctaagagtaagagaaaaattaaaacacatttaaattatatagagtttatttgagcatttggagattctttttgttttcttttctcttttcttttctttttttctttcttttgaaacagagtttccctcttgttttgcaggctggattgcaatgggtccatctcggctcactgcaacttctgcctcctgggttcaagcaattctcctgcctcagcctcccgagtagctgggattacaggtgcctgccaccacgccaggctaatttttgtatttttcgtagagatgggggttcaccatattgaacaggctgatctcgaactcctgacctcaggtgatccacccgcctcagactcccaaagtgctgggaatataggtgtgagccaccacacccagcccatttgctctagcagattattctctactcatgtaagggtggaaagtatatgtcgtttgtttactgtgactcttccagtttcttttttacagagaacccacaaagctagaagatggctactagatgaattatgtgggctctccagagttgcaagtaactataccataagaaattgaaattcatgcttttcatttaaattgtcaaatttcttgccttaaagttgttcagcatacatattattataatccttgtagtatctctagggtctataataatgtcccattttatattcttgatattggtgatgttttccttttgctaggtgttttgcagtttttaataatcttttcaaagcatcagcttttggcagcacagattttattattggtctgtgttccatttcattggttttcattttatttttaattttttctatttacttttgatgcttaatactttattttcaaatagttaaaattttataaaaatcaaaggtgcatataaggctttgactttaacaaattaaagcaaaatgagatttttacaacttcttcaatgttaatttagtaataaaatgttttttattagccaaaatatttctgctttttccaagatgaatgatttcccaatgaaggagctttgattctaagaaattgttcttgtctcttcttgactaagatttttaaatgatgaaatgaagcaccattctttaaatgtctcatgtaatatttactatagactgctgataatcttttaaagcagctaaggatgttaaaatgctgcctttgaggtaaccagccattttacaggaaatatgatactatttggtgttttaaagatgttaaaattaatttcagtccttgaaaatatgtatatagatacgtatataatttacatgagaaaatagccttggtatttcaagaggaaataaaaattgttgtgccaaactgtgctgggtttattatctatattcgagttatgaattcatattattaaggtcttttaattcaagagatgaagaaatagtttaaatatttcactccaagtgaatggtctgtctcttagatgattaaagaaacagaatagttctctactttttgtcatagtgactaatactagcaaagcacttcagtccttctctaggaaaatcaccttgtttttctacatgatttgtctctcagttacgcacatgttctatttcctgggcaggggtggaaggggagttgctctgtagaatctctggtctcacggcagaccctgtgagcaagaaataaacttagaggaggccagccactgagacttggagggtttatttgccattaccgcacagcccatcttatcctggaaaatgtaccacatgaacacaaacataaaaaacaagacattttgtattttaaaaatataactcaaattaaaaacaacaagcttttataacctgatgttagcataatcatttgcaaatattactggatattgtgccagtggctgtagttgggatgagggtcacagctgtgccgcagaaatatgacctggatcgtgggtcgggagaaatctttggccctaagtctcttggccatcagaggcaactgcaaaatcaaggtgcaccaaatactcccattcttgctgcactttgtgatgagctatagaaattcagaaaatgccagccacccaggatgttggttggacctttgccctcagaaggtttgcccatctgggtcatcatagaggagatggtggctggaccaaggctctgataatctgctcctaatgttcatctttctagtgcaatgcccattcatcaggacaaagagagaaggagccctttactgcctctccctcctgagggccgcgggctgttagggctggcctccgtcctcgatgcagtgtgcaggttattgtggatgatcatcttggtactgggcctctcctgcctgctgggtcaggcttggtggataaagagactggctcaccactgcaagagtcttctgggctgacatatggtgagtgaggcatttgatgggtgtaattctggtctgcgggatttattgccgtaagttggtcagtgctgcctggtggtgaagtgaagccatcctttgatggcttcatctattgcagacatgatattctatatcttctctggtgctgaccctcttcataccctgcaacaagttccagaagtggaaacagtaaaacatctgcctctctgtcaccacgtttttctctgtgatcatctgaagagactgtatgacatgagcctcttcatcagagctgagctgaggcctggagacctgtgaggtcaccgcattgtgcccatcttcctctcattaatgggcaggactttctcatctcccttttcatcttccatgtcatcttcagttttcagtgagccatcattccaacctgctggcaaacacccaggaatggaggacatggagttagaagagacagtgcatgaacagcatgaccttctagatgcatgaccacaacgcagctctctgaacggcacgatttcccaaaggcgctttgggaaaacttacctgattgtcctcttagaagaaacaggtatcggcccactgggatagtggtggtgctccacgatgagactatcccaaatgctacatcaagttacactggaaacagctccagtgaaagactttagctccataaggagaacttattagtgggatacatagcatggttcttccctgggagtctctaacctggtcaccccattcgcacatttaaaattattttactaaagactgcaggaataaacctcagaaaaccagtaggtgcaggagaggggctaaggaaagggagttagttaagggtaaaagaaacaatcatttggactctctcacacacattctatttcctggttttatcttttttggagatgaaatcaatgatagctgaataaggctcacagctggaggcttgaaattctagataagaaatttcatgccaattttaatacaactggatagaaaaactaacaccaggtgcctcaagcttcacacacacacacacacacacacacacacacacacacacacacacacacacacacacacatcaactggcttacaatccctgcaactaaagcaaatccaattgcagacagtgctggactcactggaaaagagctggtgattgtttctccactgggtgtcagaaagaagcaaatttgcagcctttgggctgggctgctattggttgatgggtgtggagtcccctcccaggtctcctttagaaaagctttggattccaggtatcacctcggacagcatttcttcatagaggatgctgtggttccttcttacctgatcacctgtggtaagaaagccaaagactccaccctcttcaccccagaacagccatagaaattctctgaggcagcaggctgacatttctagttagcagttgcttctgctttgactcaagaaaggtaagtatttcactagagcttatattagaaaatctggagtttgggattttcttgcttttctttcagggttgtgagcacatactacaggagagctggctttgaagcctcttaggtttgtttttgtactcagaccaagctgggtcccctgagcacttttgcattgctggtaaggaaggtgagcgcaagcctctctttcacacacaggtggacttcattgtgatgctatagaaatctcctaaaggacgcagtggcaggacatacccagcatagtaacactacccttcacattggtcattttggtataattttaaaactcatactagtgtatttaaggcattttatagttatcaagcaaattttacactttaatgctaataaataatttatcctacaaaatcttatgtatacatgggatagattaaatatgtaagaaagcatgatatatgtatgctgatcaactataattaatcagcacgtctgactagacctgaatatagataaccactcatttcagtcatgaagctccaggtggagtagaattatgtgaagagcttgcagaaaaatgattttgtttgttcaaattcctctattcagccagatgccagcattcatcttgcatgcacggtctggtcttactttcatggtttttgtcatgctctccagccatcttatctgagggcgctctggtgtttcttccaccctcaaggcacggtcatggacccaggtcagggaaaactatagcctgcacattcatagccatgtccttatctgcatcatggccaccttcacatgacacgagttaggacacctctgcatttctgtaataacagatctcccagaaccctcattttctgggcttatacaggttgtttaatgtccatcaagttaattgagtgaaatcaactttgacaacagcctttgtcatccatagtgagagataactcaagagataccatgtttgatttgggtccttccagttaaatttcatttttacttaaaagcatgtgaaagtactggttcatttaacaaaagtatcatcaactagtttcccccgatctctccagggcacccagatcccagggcagggtcctgctcccttccttctctccccacctacggaggcgctctcctttccttctccctctgcctggggagctagcctgagcaccacactgaactccatcagaccccaagaaagaaatcaagaatggcaactgaaattggtcatgcttgaagcagcacctcctggaagacctatgagttttgctcaagaaacttttgggaaccaataaaactaaactatagtgatgaatatatatacatattttttgagcaggataacattgccaggaaacttgaacgttactcttcaagtatgggatgtagggggtgcgtacaataggcggcaagaaggtggatgcatttatctatggaccacagagaatcctcttgttacaaattagcaaagcttggagaatttaaaagattggtacagccaggcgcggtggctcatgtctgtcatcccagcactttggtaggccgaggcgggcggatcacgagatcaggagatcgagaccattctggcgaacacggtgaaaccctgtctctactaaaaatacaaaaaaaaattagccgggcgtggtggcgggggcctgtagtcccagctactcgggaggctgaggcaggagaatggtgtgaaccccgggaggcggagcttgcagtgtgccgagatcgcgccactgcactccagcctgggcgacagcgagactccatctcaaaaaaaaaaaaaaaaaaaaagatgggtacattgtaccgaagaaagtgagcgaagagtcagaagctttgctactggttgccttggtgagcaataaaatttatttggagcacatggaaacagtaaaacctgaaaaacacttatggttttgccaggaaaatggttttagtagccactttatctcagccaagacaggagactgtcttcctgtattttcagaaagttgctaatgaaatccttggactcaaattaaacaaatcagaaaaatagaagagtcagagagtggtgaaggcaggtattggaaactacaaccaggcccccagaacggtgacttcctacaagctctatgtctgcatccgtgagggcatttgtttttaactaatagttctggctgcacctcacctctgcgtgggcctgagcatgtttggaaacttgttttgcacgcagccatctctgtagttcagttaacactttcctagctcacttcatcatcaagtgttgcctcacaggccaaaggcagctccttggactggtaagaattcaatttggggaccacagtctttgagttcaaaatggaaagctcattctctggaattaggctgtttcatccaaaaagaatactggctctctttgtatcctccccttttttctccttcatgtaaatacacaaaatattgaatggctgcatgaaagatgaaaagtgtccaagtcttcatcatcagccaggattttgctacagcagcttcattgtcctacctgaactcgtacatggcaaatcatacttcagaatgcaagcatttaaacacagaatatattttacctacagaaggtcctttgccattttgagtgaaaatatataaacctatgtctaactgaaaatgcttgaaataaagttgtaatcaaatttcttttatttttttaaaaagagcctaaattgtttacgtcatagcttgtaaaaatagtatcagatattgtatttttactattgtatgatggtcactatgtactacgtaacattcaggttaaatagctttatgaattttgataaatgttcctctgtagctccacatgtaatttctcttgcaaactgtataagaatactcctagaatgagttatgacagatcgttggatcattgtggatcagaccatacctgatgttcagatattttttcttccacaaatacatttatttaaatgactttttaaaagtgacataaactaattgggcacactgtaataatctcaggcaccactgcctgagaactgatgtttctgctgcttttcccttatcttgacctattcttcatggttacatgatagtcatatacagtatatgcccttgttcatctataattcaagtgtattcctttctctgggctaacatggttattattttctttccatttgttttcagaaaacaaattttatttcattacaatgaactgagcatgtttatttattttaataagttgtccctgtataattttattgtgctaccttttttattatccatgtcttcagaaaatatttatgtaagaaagatattcataatactgatgtatcattatattaatcttatttgtaatccaatcattttcctttatatttcttaaataaactacactagaattatgtcacaagtaaagttttgtagatcaccatcttcttactgttactttgtaacgggaattctgaaataacaatattattgtagcttatattatttttctgttaatcaaagatacatttaattaattagaattttttcctttttgtactcaggttctaccactcttctattttgcattagagagttcttaaagaaagctgttgattggatatagtaaataatttaaaaatcaatgtttaatatataaagtttttcttactaaaaaaaatcacccaattaaaagtgggctaaagatgggaatggacattttgcagaaataaataaaccacaaatgacccataaaaatttttttttttttgagaccgagtgtcactctgtcacccaggctggagtgcagtggcacaagttcggcttactgcaacctccacctcccaggttcaagcaattctcatgcctcaggctctcgagtagctaggactacaggcacacaccaccacacctggctaatttttgtttttgtttttgtttttagtagagacaggggttccaccatgtcagccaggctggtctcgaactgacctcaagtgatccgctggcctcggcctcccaaagtgctgggattacgagcgtgagccatcagacctggccgacctataaactcttttttttttcttcttattccttgaaactgctcgtattgcaagtttttcatggatgaaatatggaattgagcagattctttttttctacaaaattatggtataaacttgctcaattttctatcttattgctaatacatcttacaggcacacagtttgtaaagtaaaccccttaagggctgagtgcgtagagtgtgctgcaaggtacaagaaataagctaaaaatgagcatataaacctacatctggaccaacacggtactgaatgctggagtctgagcaaagaatgagtgatgaaaacagcaaagctggaaaaaaatgctactaataataatttctgaaaagtctattaatgaaatttttttcaaaatagcccaggaaaccagaaagacaatgttctgtatggaaacactgtaggaagttacagttttgcattcacaaattaccgtggctcctgttttatgggacagtaaaagcttaccacaatctagaggtagtttttactctaagaaggatgattgtattactagactgtgccgtatcatattatgcacgtggttcttgtactaaatgtagcccaaagagtctgctgcaatttcgaagaatccgaacaaaagctaagcgaagttcaggaatgaaagcaaggtacaactgccgagtttcgcatgcaaggccaatgtacaaccctgaatgcaaccaaatctcagctgaaaggaaaagaaacattttctgagttaggagacatttgtggagatgctcagtactggagaagagaaaacaaacaaaaaaggcagggaaaagaaaaataaaaacacaagttacatttgcatttcataatcttacaactatctgtttctaaagtactgtcttccagctattttagttgatcatctaataaaagcatcttatgttttaagattacaatgatgttctggcctaggctaccccctccaacacccccaaaaagtaaagttaataaaacatgcttttgctgagatcttcctcattctaccataagggcaccatctcccaactggtagcagatgcttctcatgatattttttgtcacttgccaacaaggcagaaaatactctgctggatgaaatcactgggaacattccaagttcaaaatgaaatgtttaacttatacgtaatacaagttatgtacaagatcaggagcggggaaaaacctgaacaaatcctggaacacacataatgtatttacgttatgggaaaaggagagagaacacttcaaatatcaacatgttctgcgctattaactcatttatggcaaaatggccacaccaaattgcatgtgaatgttagaacctcttggataaccactagaaatactttttttaaaaaaaaggaaaatgcagaaataactaccaacagtgtctgcgaagagagactaagttaacatacattgcatgtgttgcaggcaaggcagaggcagctttttaaagcttttgcacagacttcacataatcttaaaaaaaaatgtaggccttcacaagatttgacttgctgaaatccaaacaattttgactcacgaaaagtcgtaagacttcagctggaaaaaaaaaaaaaagctctagcctcggaccaaaaaaaaacttggaagaacatgataattagattaagcaagcatggccaggcttggaacctgaatgtattttaaagcaaaagctcaaaggtgagtggggaagagaacaacctctttggtgacaagatgtactataataccatgatataaaaaagggtatggtgaatatgtgaaaatgtaccttttactaaagcttatacaatatacaagttacttggtccataaaaactatgttagatttatgtcttctagtttgttcaacttgtattccagccacattatttacttcttgcccacttaaacaaaaccaaacaaaaaccaaccaaccaaccaaccaaccaaccaaccaacaaaacagctgaaaaaattaatttccaagtttttacattttgatgtttttttgttttactgtggcttctgcatttcaaatcagcacttgcagatagatagtggggttttagaatagtatcacctggtgtgaaaagttttcccaataaaccacaaaagactgttcatttttttctccttttttgtcaactttttgctgcactcaagtccgtttaagtcttagcaaaaagacggtagttaggataccactgttggtgtagatgatgtgacactggttgaatttgtgctggcgtttgtgtaacttccgtcgctgtttgtgtttaattcattagggggcacgtggcttgaactggcttgaaggatggcacctgctacactgcaatgtggccgcggccctgcttctggtgtgtaggtaaaggtaaggctggtggaatatatgattccatcatttcggaccaaagttactgaaacctgtattggttgctggacctatctccaaccttctcagaatgcagaaacgtctgggacaacacgagcatactctctccacacctgtacatagcttcagcttctacatccccaaaccacacttgtaaatttggagtgaaattctgtcctgtaagttcaagcattggttcgtccccaccgccattcaacttaaggctctctacgacaggcggaggcatgaccagggcaaggacagggcccactctctcgtaaaatgtatgcttcgccttatgtgtgctaatgattgcccaggaagcaccatcatttatcttctctttatttggttcttttgggcatggagtggcctgaaattgaattattctttcttgagaaaggcataagtactttctttctgtatcctcaaggtcaaatgcacatttatggagttgtgacacaggatcatctgcatccaataatgtggtctgcttatcaactttcctaattatcaatcttgggagtgccatgccagtaactgagcacacaagtttgactgtttgtccataatgaatgtagccatctcagactgtgaattcttctccttctgatccatcatcatccaagaataatgtaaaatgctccccattgctgtgaactagcatgaaaattacctctttctacgtgcaagtatctggtactaactgtctgggatagtagtcgattaaacagagccaccttttttcctgaggcaatgcataagtcagcatttttcaatgactgcttctttttggaaggtttggatgacttgctgaggaacacaccaatgtcatcactgttgccatagaacacctttacagacaacatgaagtgcttttgcttgtctaaatcagatatgtacaatgttttggctgtgcaatagttctttccttccaagtttagctgctgcatttcttggtcactatttcctatgccaataaatgcacatggttgagacccttgttcagaacaaccatcgcatttcatttgttattttattttcttccatccactgcccataagatatacacaagggggagggcaaaaaaaaccttttttcatttccatatgacttctgtacaacttttgcatgaaggctaagtactatttgatccccttacccttttaaataatttcacatagcttccctagtaagtcgtttaaatggaggccacttaccaaatttccttttaatccatgccatggtacctcaagaacatgttaaggtaagtaacagcttggaacttttcaatgcacctcaaaacacctcagccagtgtatctgtatcattctccttcattttgaaataataatgtttccaaagaactgtaatgcttccatttgaatgatagtcttataatttcaatgacgttccacaggctgtacaggaagcatggcagcatctgcttctggggagtcttcagggggcttttactcgtggcagacagcaaagcaggagcaagtaacttacatccccataaactcttaaatgattagtaatcacagaccatgataacatactaatttttatgtactggaacaactaaaattaagaagtctgataagagaaagaaaatccaacattacatgcctctgaatatgattcaataggaagcacactgcaccacctttgaagtattcttgccaaaagaatataaaactaaaagaacttaaatcaacctcttgttctaactatcagtttatatgtgttaaattataccataaggctgcactaagccaaacacaaaatgtgggaaattctacaggcgaatgacctagttttttctgcaaatacatggagtcaggtgggaagaagatattgtgatcaattaaaactgttaaagttaaagaaagaggaaagaaacatgaaaagtggcttaagagtcaaagacaggtttattttggagaataaacctgagaggggcttctggccgatttcggttaggaacactctctcttccagagtaagagtatttattggtgagagagcttatcacaggcttggaatgtttctgtatgggggagaagctcatggcggggttggaatgtctatggtcagaggggaggttttcttggggctgacatctctccagctggaggggaggttatctgggggctggcatgtctctggtcagggaggggtttatcctatggttggaatgtttctggttggacatgtcatttgtggtttatggtcatgctgaccttagccattaggctgatgccctttggatttaggtggtttttaggtggatcaaggggaactttagaatggtggtacttgtccatgatggcgatgctcctgctctgtcaaaaacctctgtcaaccaaatgcagtgtgcgtggacttgtttggattctcactgaaaaagagatctgtgagacaatcatgaaaacctgaacaccaaacattagatgatattaaggaattactgttaatttatttagttgtgttaatggtactactatcatgtattttaaaagtcctttcccttaaagatacatagctatatattttaaaatgatataatatgatgtctggggtttgtgctaaaattatgcttgagtgtgtgtttgtgggagggatatatatgaaattttaagactactccatatatttataattattgaagtagagtgtaaggaatacattgggttttattacttttgtctctacttccatgtatgtttgaaaattttcataataaaaattgtaaataaaagtctaataaaaatcatagttttaaaaattaggatgaaaaatcatgaataacaaataagatctaataaaaatattgtatagtgtcatagtgtaaaagtattttatgaagacacatattggtaattatattttaaaactccataaatcgaaaagttcaacaaccatactgtaacctcctgatgggttcttcccgcctgctgcacaaaaaaaatcaattcacagagaccagggcattgcagtaaaggaagaatttaattgatgtgaagccagccacaccacacaggaggtggagttattaaatcaaactcatcaaaagcttgtaggttagggttctttcaaaggtaatttgggggaagtgatgagggtggctaggcaatggctgctttctgctgattgttttgggggtgcaatcttaacatgggaaaatatcctgctctgtgctgaatggcttctgcttctgcatggggccacatgagcagttggtgggttcagaaggcaccataattggtgccaaacacgcaaaatatctgaaaggctatctcaaaaggccaatcttgggttctacagtagtgatgttatctgcaggagtaattggaaaagttgcatatctcgtgacctctggaataatggctggcagtcttttatgtctacccctttgccgaattcaggctcttctcctcctagcctggtggtctctcattagctttataaaggtgattgagttttggagaaggactattatcatttaaactgtaaactacatgtctcccaaagctagcccatcctaagcctggtaataattaaggcaacatgaaggtaaaatataagagggaagttggctatattagatcttccccactgccataattttctcactgttataattattgcaaatgcagtttcaatatgagttgtttttcaattcaacctctggctttctaattaaaaatgattagttaaacacatgtgcatcttcttcctattctaccaacatcctattgaaatgaccatgtgatggacaaaagagaagatacgtgtccatgctgagaacaggatgcaaaaccttcagcagactagagggcaggagatgggaacacactgggatgtgtagcccaaacgatgcaaagaacagagttgagggtgagatagaaacccctcacaaaagaaagacacaaacctagaatcccaggcatgcatcacaagcaactgcagtgctattaaagggctgtttatggatcagctgggccagtcagcttcccttcctcccatcctgcaacttctggcagtagctggcagcagttatttaaaagacaccagccaagccggttcctgagtgagtccaaccacagtcagcccagggccagcctcgtggctcccaatctgtggtactgagggtcatgatcattaattacatttccaatgaaacaataattgcctttagtaaactacaggagcataagtagaagcgatattgtagtaaatgtctcatatcattacttctgccagaaatacctctgcccttgcattttcaaaagatatttgctgcatccttttctgaaatacatttttatgatctcaattccttcaaaacctaactttattttatttatttatttatttatttatttatttatttatttatttgagacagagtctcgttctgtcacccaggctggagtgcaatggtgcgatctctgctcactgcaacttccgcctcccaggttcaagcgattctcctgcctcagcctcctgagtagctgggattacaggcacctgccaccacacccagctaattttggtatttttagtagagacggggtttcactatgttggccaggctggtcttgaactcctgacctcaggtgatccaccagcctcggcctcccacagtgctgggattacaggcgtgagccacctcgcctggcccaaaaacctaactttaattatttccctagccactatactgatcattttatttagtgctttttttacaccattacatatacatataaggaaaactggcatcttttacatatttatttatttttatcctgttttcctctaaaaactattaaggcaacttccaaaatatattctacataatgagattaataaacaagcaaagtaactaaatcagtaagaaaatctagcttggattggtatgggttaaaaaataaatacacaaaatatatcatgatatttatttggtctaatataggcttcccatgcacccccctctccccaccgcccccaaccccctccccaccgcccccaaccccctcccgagaggacagggatgcccgggtccgaagccatggctgggcagctgcccttgcgcctgggactgcagggctccctccccagcagctcagaagcggccagggctcccgccggctccacaaagtgcgccgccctgcggcgcctcccctgctgcagccggcatcttggcagcagcctctccagatgggccgctgccatcaacaccacccaaaccggtaatgtggctcagccagttctgcgatcccacccaggaacagaaggcagcaagaaaacctcactttgatccccctgtgattctatctccaacctgaccaatcagcactccccgcttcctgagcctctgccatattacccttaaaaactctcatcccaaacgctcggggagactgatttgagcaataataaaactccagtctcccacccagctggctgtgcaagaatgactctttctctattgcaattcccctgtcttgataaatcagctctgtctaggcagggggcaaggggaacttgttgggcggtggtgaatatatattaatatatatgcactcacacacacaaatatatgtaatatttgcaactggaagtagaacaggacctcctaatacaaagacgagctcctgtagcatcaggagtcagcagctccctgccaggtggagcctccgttgtggtcatactattgagggggcccccacctgaacgccagtccccgcccctgattcagccatttcgcagatatttattcagatgttccaggaactattctaagggcatcaggtgctgttcttgtcacaggcaaagaaagccccaaagggaaggtgtctcttccggcggtgcctgccccacctccaagcctggcagctttcgaaatttatcttaggacatttccgacaggtgttgctcttcttcagctttgtcctggcataattttgtctcccaggagccttcattttcttccttcattgatcctacatgtgctgtagctaacaggaattcctcagagctcgtagcctttggatagcgtggtttcacggttgtcaacactgatatgtttatctatactttgagcttcgtgtagtttttcattaggattttgtgaaatgcacaggatgatgtaggctacaatggtaggttcgattagctatgttccttgatgatttcacagtaacttatatttaaataaccaaactattcagatttatgcttctatgataagagatttcagtatttttgaatcaaaccattttaagggttttttttttttaatgaaacacttacttaaaatgattacataactttcccttgcatgccacattttaggcaaaattaacagcatattcctaaaacccagcttactaaattgcttctcttcatagttttttttgtttttaaccgaggaagaatttctgatgggaagctttaattatagtgagctatgtactagccaaggaaggcaataaattgaaaatatgctgtttaattttattgttgtttgtttggctggagaacactacagttttatttctattcataaaccagtgcttcccaaccagggctgtttttgcctccagggaagaaaatgtctggagacatcttgggttgtcaaaactgggggttgctactggcacttagagagtacaggctatggatgctgctaagcatgccatcttgcacagaacagcctgtaccctcccttctcctctgcaagaagaattaaaaattatctgactcaaaaggttaacactgctaagattaagaaactctgccatcgaccagtggaagtaaaaattgtaaggatttattatttcaaatctatacagctttacctcacgagttttactttttctaattctctttagggaagtttctcttccctctcattttccaaacgaagttgtgatttttggcgtgaactactccaccccacagcccagcttctgcgcttgaagatgttgtggatatgggctccatgcttgtagtggcgaacttccaggcctgtcacatgtcctgctaccccagaccactccatcacatgacctgtgcatacaccttacatcattctgaaatgcccttcacatatgccctcttccagaatataaaacatcttccttgcataaatacttccaaggaaaggctggccacactctgactacttaaactccttgaagttttgttctatgaaaaacataaatggtggttcagctggcagcatcctcagtaacactcttgatattttctatcctctagttttctccatctgtttgagagaacacactttgggttatctggggtctatgccaaaggaggcattgtggataagtgtggctcagccttcctcaacaaaaaattacctttcaattcagggcagaagcttatgatattaaaactcatgtggttcctcgagaatctccttaatacactttcctcgtgagccaggggtgagggtaactggcaaagcaatcaggtcttggcgccaacaaaatcccatttcttccctgaaatacaaggcccatcaggacgtgacatctgtctgtattacttcctactatataatccccagtaactagaacaaagcagttaaacaatattcaacagtcagaaatatatttatcatatgctgctaaaaataccctccattttctagctctctaatcagttaacatgtgcacatttaaactacatcacagcattggatttgttctatctgtctgtatggatacaattgtgctgctgacaatttagtcaagtgtttcatctctatgtagacaaccatcatgtaagaattaatgagaatttcctaacatcatggtggcaactggcagctattgctctgaaaatttctggctctgaaaaatcttaggccaacatgttcacagtaatgttttagtttaaagagcttggaaatggggtttcctggaatgtattggaataaaccatgtattttattcccagttttgggagatatctgctttccttacgttccccaggctaccaccatccaaaagcagaaaagccatttagggaaccaagagttttagtcaagctatttaactgtcatcagaaataaagaaaacaaatcacctctacagccttctgggttaatttttataaggtggtttgtcttcattcagtggaaaagaataatcttaacttcaggtcattggcaggtcaataaaagctctaaagctaaattttcaccaaaatctcagttgagataagtaatatttaaggattatttggaagaataggctccactgatttctgtaataaccagagatttaatactggattaatccagaccatcatataactccatactcaagccatattgtcttgattgcccaagaaattgcttttaagaaattgtcatatatttattgtccaaaacgtgtttattatagggttattgttgaagacaatgtcccctttattgcttggtgactccaatgaaaggccccaataaacattgctctcagacttgattttgacaacaaaacctctcacataaaatactgaaagtatgaatgttagaattcttttttatttctgggaagctgagatacaaatacagaaacaaaattcagtgacatagatctttatcatatcttgcatggtcctctgaaataggaagaaaacattaaattttaacttttgactttagggtaaaaacatcacttttatacaaatcaaaaacaaagaagaaaagaaccccatacaaattataaagacaaaggctgacaaaattgaccataataaaataaaatttctgtgcaacaagacactaggaataaaagtttgtaagaaaagctagtgggaacaaaaagatattcacaacatcattgaagatataaagattgatatccaaaataaaaacctcttattaaaaaagaaagaaaaagtaaatgaaagtacaaacagattaagaagagaaaacatggccgggcgcggtggctcacgcctgtaatcccagcactctgggaggccgaggcagacggatcacgaggtcaggagtttgagaccagcctggccaacatggtgaaaccccatctctactaaacatacaaaaattagctgggtgtggtggggggcacctgtagccccagctactcaggaggctgaggcaggagaatcacttaaacccaggaggcagaggttgcagtgagccgagatcatgccactgcactccagcctggcgacagagtaagactccatctcaaaaaacagaaaaaaagagagagaaaaaacattaatgactaacaaatgtatctaaagattctcagactcattagtagtcaaaaaagtgtacattatagcaatgatgagagtgcaattctctttatctgaactggtaaacataaaaaagtcagacaaaatcaagcattactgaagtgacgataaaggagttatctggtgatgctggtgggaagatacagcggctgtgcgaggtgattctacaacatgacttacaggcgagtactcatgcgcaccctctgccccagcaacctgacagctcttcccctgccatcttccatggtccacacaaacatgcatgagtgtgtcctgggcagctgcaccctcacctttgtgcatcacagcagggtccacctgctctgagtccttatgacatgacgctattctcagtgtcctggtatgttcctgtcactgtacaatggctcccataagccctactgctgcctggaacaaagagaaactttggttatatagtgtgtatttgcataaagaccgttttcaaagagcaagaagaatataaaagaaataaatctgtgcctgtatatagactccctaaagctgtctctggcctccagtttaaaaacatctagaatctagccaggcccttgcctttccttgaagcacacttatctgcctagaattaggtgtaaataattttgttctattacccaccccacgattctgaagaactggctcaaatgtacccaaactctggtacacatttgtcaatgctgcctcttacaggacaaaaaaaaactgagtattttctttcagaccctcatacactttccacattgaaaatgtgggatattctgtatttccacaagcagttctttctctctcctttgtctctctcctatttttcttgaaacccctactctctcactctgtgatttgtctaaatataataaagatataggtacaaaaaatattttactttcctcttaattctactatgagaagaaagcattaagttcaatgataaagggcagctggtaattgaacttaggtgtaggcagaaagacactggtagggatgaggcaaacaagaaagtctgttttccatgtaaagggtgaaacagtttctcagcaattgctgagatcaaggataagccctacaagtttgggcgggaaagaggactcttattactctgagggaatgcagaaatccctccgttttgttgttgtttgttttctctgagcccttgtgatctggcccccaagaattcctgtggtggcagcagcaggcggtgcctaggagaaacaaaaccctgaggccagggcatcttcctctccagttggtgcagttatgatcccaagagggtgatgcaaactttttgaagtcttttctcattttgccacctgtcacctggctccaaacatgggtgcagccatgaaacactgtagcagagtaccgtaatcaaagacccagcattctggccagaaaacagaaaagaggagctccaggaaaccagaaaatattggagacactgtggagaggaaggagtatgagaaagtgacaccataaagtttttaatggactgagcgcatccccaagctgcatgtgtgtggatctgctcctaattagttaaccaaagattttgagaacgaagctagcagattatcatccgagttccacactgaccaccaggacatatctgaagcaaactggaaaggctttgaaaactcaactgattgttggaaccacagctcacaaaacagagattggaacttgcagcttgaatatgacaaggtcaattgcttctaaaacaaaaatagcatcaatccgcctaatattttatgaagacccagagcctcaaaacttaatgtccatgacacaatccaaaattacaaaaaaaaccagataaactgcaccccacatgagaaaagacagtcagtactaagtagctaccaatactgagaagaaaaataaatttgaattacatcacaaggattttaaagcagcttttataaaaatgttccaacaagtggtcgcaaacactttttttttttcttgagaccgcgtctcactctgtcacccaggctacagtgcagtggcgcaatctaggctcactgcaacctcggcctcccgggttcaaacgattctcctgcctcagcctcccaagtagctagaactacaggcatgcgccaccacgtccagctaatttctgtatttttagtagagaaggggtttcaccatgttggccaagatggtctcgatctcttgaccccatgatctgccctcctcggcctcccaaagtgccgggattacagacgtgagccaccatgcccggccgcaaacacttttataccaatggaaaactagaagtatcagaaaataaatagaagatgtaaaaaggaacaaaatgaatatattaggaccaaaaaatccaataactgacatacaaaattctaagtaagctttttattacaataaaactaaagaggtaaggatctgttatcacgactataaatcaacagaaattatctaatctgaacaatagagagaaagaaagatgaaaaagtcttgattagagccttagagacttgaggaacaataactaaagttccaacatacatgtcatctgagtctcagaaggagaaaaggaaaaggagtgcagtgctgaaaaaattttgaaaacctaacaggaaaaattacccaaatttggcaaaaggcaaacattaattgaactaaaagaagaaataaacaaatgtacaattatgattagataattcaacactcctctctcgctaataattagtgaacatttgaaattaattgatggtaagtttgattaattctgagatttttagcagtattgtttatcacatagaattaacagatcatttctgtatagcaggcaaaaatgcattctgagccacatgtaatagttcatcacacaaaatgttgagttaatgccagtcagaatgtctctcttcttccagtacagggattacaaaataatggcaagacctaaggtcatgtatgcagtgatgcactaagtaccttaaataataggacatgagattgcaagcacaatgcagtcactatgaatgagaaaattatgtaagagctcaagttcatgtgctgaggaggcttctgagaagccttaaaggatatctggccaattcagctgttactgggttagactattaattgtcttattgccttaactctcatcaaaaaaagactgttctgcaggctttttttactgtgggcaagtgattaacaacaccccagctagaaaattcttcctgatgtctgtcctgagtctctcctgatctaacaagcaacggtatacaagaacttatcaactccatcatcaattacaaaaaaaaattgttgtcataatcatagtatatgatttaaggatttactaaaatgcaatggtagtcaagctatcagaggatggaggaacctccgtttcaccatctggttgttcctctttgttccctttaggttagtctgagccaaaacacccaacactaatcacaatgctttgtccatttcagcaggcataattccttacaacaacaaataaaataattcctaagtatttatttcataaaataaatgtattagatattttgtcctcacaaaaataagagatagagtctactcaaaacagtgttttgtgtatgattttcataaatttcaaattagaatgtaaagtttatcatatctcttccatttgttaggatagtgttagtaacatttataaaatcattttctttctcctgtacttatttgacataaaatgtgtcattctctgagaatataagatgaaatcattccacagaagaattacttatattcagagttatttatgtgtaacagtactccataaattccctttgagggccttgttccattcagcaagaagaatgtcttgatggtaggcaaaattgtacgtaagttaaaagtatgaaatttgaatcaagctctgccattgaattgtcacgtgaacctggaacaacataacctctccctgccttagtttctctatttatataatggtaagtataataaaagtatacttcaagggcttttgcaagcactatatgaaccaatagatctaacacatttagaacggtaacttgatattttaggcgccttgtaagttattgttattatctgcaattgtatctacccaaaagctagaatccctcttcttggcccccaaattcctatgacatgtctataaatatcttctaaatatatttattcattttatgcatgcatttacttgtattctgaatgcctttacatgtgccaggcattgtctaggtgttggagaaactaagactgacttgaaggagatatttacttaaaagaaatagctgtaatgggtataatttgcagagggggagaaccctgtgaaaaagagagtaattagaaaacttcattttgaatataaagagaaaaaacttttctgagttcatgaaagaattattgatatcatcaacaataaacagcatatgctaatatttatatttcctaactattctacatacctatatttatatagatttcagctaacaactgggcctcagttctactatgacatattgctaaaagcattgattatataagttcatattatatgcagtgtttgcatgagataaaactttaagacaaaaaaatctgctccaaaaagtgccttggtcttcgtagcttattcaagacatttattttatattctgcagactgtggaacatctgtttattaatgcagctttatgatatgttgtaaattgccttaacagaaaatatgaaattgcacattcgagcccagattttcttttcatcctcttgtgttcagcttggcaaaaggctgatactgccagaaaaagaaagaaaactttgttcaaaattgaagttaatactttcttggagaaataactactaactaaagacaaatacttgatgagactattttaatgtatctattgtccttattatgtaggatataatttcttactttaacatatgatgattttatttcaaagccattttgactgaatgactttcaaggttattttgaaaatcataataatttaaatacttaaggaagctagtcaaaaatttgaaattaattgatggtaagtttgattaattctgagacttttagctgtattatttatcacacggaagagaagatcatttctatatagcaaacaaaaatgcgttccgagccatatgtaatagtccatcacacaaaatgttgagttaatgccagtcagaatgtctctctttttcaagtactgggataacaaaataatggcaagacccaaaatcgtgtgtgcggtgatgcactaaaataccttgaataataacagatggggccggacgcggtggctcacgcctgtaatcccaacactttgagaggccgagacgggcagatcacgaacaatgcctggccccacactggagggcacagtgaaccaggttccactggccaagagtcactcgtgtaggtgtctctgagctaggagatgtgtactaattcctaacaggcaagagtttaggccggcattggccatcagagaggatgagagaaaaaatttgtcttatttatggagctagcataagaggaagctagagctttactaaatgtgaaaatttaagttgatgtatattctacatcctgaacacccagtgacaaactgatgttccaatatctgtttatacaacgtgtgtgttatcattacactggcaaaatggatgatatgtttgccttatttcaaatcactaagttttgtattatggtgatatactcatactgctttcttatcaactcagaaatccattatacaaaatccactttttatggccatctaaatcctttattcagtaccatcagcctgggacatgttaatatatttctgctagacataccacccagacttgaaatgcataggacactaagcacatagtggtagcagcatgttttcctttaataaaaagacattattttgggaggcagttttacatttacaagaaaattgagcagacaatacagagagttccttaaaccctccttagctcatcatgcctattattaagatatcttgcattcgtctggtgtatttgttacaattaatgagccaatattgatacattattattattaactaaaattaacagtttcattaaggtgcactgtttgtgttgtatattctatgggtttggaaaatgtgtaatgtcatatatccaccatgacattttacagaatggtttcactgccttaaaagtcccctgtgctccacctattgatccctccttctccctgcaaatccctggcaacaactgtacttttcattgtcttcatcgttctgccttttaaagaatgtcatatagttcggcttacacagtatgtagtcttttcagatcggcttctttcacttagcgatgggcttctaaggtttttttttttttttccatgtcttctcatagttaaatagtgtgtacctttttatcacttaataacattctattgtatgagtgtaccagagtttgtttatccattcacttactgaagttgcttccacctttgggcaattatgaataaaactcctataaacatcaatgtgcagatttttgtgttgacctcagttttccatacctttggttaaatgccaagacacaattactggatcttatagtgacagtatacttagttttgtgagaaaccacttcccttccaaagtggctgtatggggttgtatgggaaatatttgaattaacatccaaatcacacaatctttttgttacactttaagcattaagagatttgttgtcatagttaccttgggagttagtggcttctgaggagttgacaagggctcttggtaatgtggtgcatattaacgttaacaggttatattaatgaataaacaatgcatgaactatgaaatgtaagaccatgcagagtatattattaataaataaataatgattctgtactacgtatttaccttttgacagagaggtgcacaacaaaaacaaatgttgatattcttgaaaattttgaagtcaagtctcaacaattaaatataaattttgtctttccatgtaagtgatagactaatgaatctacagatttgcaagtttataagccgaagtgaatgagtgcctccttctgaaaattattattgggcttatgagtttataagcgcatgcatttcaccctggttggcctaagctggcaatttcctccaagtgggcatattaggaataccaaatgtcacgaacagactgcaaagagagagaggaagggaacatttagcttctgacagctgaacacaagaaaagggtccaaccaagtttcctgggaaagctggaggttacaaacatcagatgaccaatacctaacttctcttgtttattttaattcttctgttttaatagataatatttcattttgacattttaaggaacatttctgtgtctctgttctggcccctgatgttacctttggagactagggggaagagagagggagtaattaatatatttataagaacatatttttgagtaagaagaatatgcatgagttaatatttattaatatatttttattaatccaaatatattcacaagaaattatttatatttaagaatatactcaataacatatatgtaaaatatgttattcaggagtgcgttcttaattcacatgttctttgtgccacatgtgtccactgatttctgtggaagattcataaaaacgatatgtaaggtatccgaactgctgaaaaccacagacaatgagaaaaatctcgaaggcagctagaggaaaaattaagcatttacatcaagcatttatcaatgagaagaatatattcatcggaagaattgtattagtccgttctcacgctgctaataaaggcatacccgagactgggtaatttgtaaaagggaggtttaattgactcacagttcagcatggctggggaggcctcaggaaacttaaaatcatggcagaaggggaagcaaacatgtcctccttcacatgatggcagaaaggagaagtgctgagcaaacgggggaaaagccccttataaaaccatcagttctcatgagaactcactcactattatgagaacagcagcatggaagtaaccgcccccatgattcaattacctcccactgggtccttccacaacacatggggattatgggaactacaagttaagatgagatttgggtggggacacagccaaatcatatcaagaatatattttaaaaataaatcattttattcaagaataaactcatataaatatgtttatcttttgcaccatcagtttttccttttttcttttagcttccatctgtcaaagcagaaagccaggtcagagatagaccagccatcccttcacatttgctgagactatgacacaagaaaattagtcaaccttaaatagttagcagaaacaaatttaacaaaatagtcatcagtaaattggccactcagcaaagtggctttgtcagtggacctggtcgagagagctaggacctgctgccacagaaactgccttggtcaggtgaaacaaccccacagcagtaagtgtaggtagaaaatcaggactgaagcaattacacatgttgtcattgacctttccatctgcaggggataatgcagtgaaaccctgccacctttccacaggctaactctcagaggaataaaaaaaaagtcatgtgcaggttgatttgggctaacgaatgatctttcatcattcaacttttgatgttcaaaagtatgctattatatttgtgcacatgtgaaatgaaagagaaaggagcttggacacatgaaaaccaaggaaagaaaaacctaatttgttttactaataaagaataacagaaaaaagggtaataccaatttcacttgcttctatgtctcttttctatgccctcaggaagtacaatttaccactttgggaagcttaggagggagcatcgcttaagaccaggagttcaagaccagcctgggcatcatatagatgtctcttctaaaagcactactaatgcaataaaatgtattctcgttgaaaattacatctgcagagaataaaacaggaaaaatctgctgtcttttcacactcaattgtttatcttctgatctgattcatcttgccattgtatgttgcatataagttgtaataaactaaaatttaacatattgtggtatatatacaccgtggaatagtagaatactatgcaactataaaaaagaatgagatcatgtccttttcaggaacatgatgaagctggaggccattatccttagcaaactaacagaggaactgaaaacaaaataccgcatcttctcacctacaagtgggagttaaatgatgagaacacatggatacatagaggggaaagacacacactggggcctacctgagattggagggtgggaggagggaaaggggtacaaaaaataactattggttactaggcttaatacctgagtgatgacataatctgtacaacaaacccctatgacacgcgtttacctatataacaaacctgcccatgtaacccaaacttaaaataaaagtttaacatataaatatatatatagtggcattttggacagacatttacatatagagatgcatgaatacatagatcaatagatgtatgtattcacgggttattaggaatgcaaataggcatttaaaaatagggtttccagcactttgggaggccgaggcgggaagatcacgagatcaggagatcgagaccatcctggctaacacagtgaaaccctgtatctataaaaatacacacaaaaaatagccaggcatggtggtgggcacttgtagtcccagctactcaggaggctgaggtaggagaactgcttgaacctgggaggcggaggttgcagtgagctgagatcatgccactgcactccagcctgggtgacagagtgagactccatctcaaaaaaaaaaaaaaggatttctgggcatttttggttgtcgttttgtctgttttgtttttatctattgacactagcaggaaggcttacttttttatagtaggtatatatttcaaaccatagtcttaggtcttgtgacatagttaaaggaaacatcatagaagagctcagagatgtaaaatagagccatttatgatggttttgagaacctgtaacgatacatatatgttaatttcatttaggttttctgcgtttggaactgtgtacaggtaagatgctctaagctaccatatagcaaaatttaaatgaaaattaccattacacttatttagctccaaataatttaataactattactgggttgttactagaaagaaaaacagctcactgtaatagttaacgaagcaaagcagtcccaatcaaatcttgcattgctctgacacgtgttttgctaaaggagagggagaggcattttgttgtatttccagctggcttcctggggaaacagaacacatttggagaatgtgttcccctttgttaattgtgacacatgtgtccagtgacccccgatgaagaactcttaaaatgatatggaatgtgttcaaattgctgaaaaccagagacaaagagaaatcaacacaaaaactgaaaatctctcatttttctcaaaagagaaacatcttgaggaagctagaggaaaaaaggcattatcaaacaagaaacaaggttaagaatgggagctgacttcatatcagaaaccatgcaagcaagaaacaaagtgacacttttgaagtcataaaagaatttttaaaaacctatcaatccagaattctataaccattgaaaaattctttaaatatttgttaattactctggtgtctttgaattaaggtgaagttgaattcccctcatgtggcttgcaagttagtcttgtttttgtggtttgggtttttgtttttgagataaggtcttcctctgtcatccaggccgaagtgcattggcacaatcacagctcactgcaaccccaacatcccagactcaagtgatcctcccacctcagcctcccacattgctgagactacaggtgcactccaccacacctggctaatttttgtaacttttgtagagatggggtttcaccatgttgcccaggctggttttgaacttctgggctcaagcaatctgcccaccttggtctctcaaagtcctggaattacagacatgagccactgtgcccagtcttgcaggttggtcttaatgactgacttttaagaaatggaatatggaaaagtaaaaactgtagttttgtagtggaagaaaccatcaagtcaccaacacaaccaagtaatcaaggttaacatcaacaatgaaaagtcatatggctacctcacaccaccgtgacacaatgggaaggtcacttcagctatgtgaaattcttcctcaaaatttacaaccccactttaatcaagagaaaacatcagatgaactcaaatcatttgatgcacattctaaaaaaatatctggtcagtggtcttcaaggtgtcaaagccaggaaagacagagagattgtccctaattgaagtagactaaggagacatgaagactaaacacaatatgagatcctggatggtacctgggaacaaagagaagaaattagttaaaaacaaaaacaaaaacaaaaacaaaaacaaactggtgaaatgtgggccgggcacggtggctcactcctgtaatcccagcactttgggaggcaaggcaggtggatcacctgaggtcaggagtctgagaccagcctggccagcgtggtgaaatcccatctctactaaaaatacaaaaattagccggatgtggtgttgggcacctgtaatcccagctgctcgggtggctgaggaatgaaaatcacttgaaaccaggaggttgaggttacagtgagccaagatcgcaccactgcactccagcctaggcattagagtgagacttcctctcaaaaatgaaaaactggttaaatatagcctgtcatttaggtaatagtattgtacaatgttaatttctcgtttttaataaatgtgccatggtaacgtaagaggttaacatcagaagaaactaagtgaagagtgtataggaactgtctttaccatctttgcaactctatgtaaatctaaaattattccagagaatgacttcacaaggtggcagaatagaatttctccagctccacacccccacacggaaatccaactagcaactatccacaggcaagaatacctttctgaatatcccagaactcaggagtgagactgagacacccaattgtactgcagaactaagaaaagctgtgctttgaagggtaagaggaacagttcattttgagcatgtcacccctccaccaagctggcacagcacgacacacagaggatttcaccagacccacaatttctacagtgggaaaagaaagttggaggtggacattcagcttgcccaccattctaggacccttcacaggaggctcatccttgtcttataccacaggaaacattaggagtgccatcggggctagaccacctggagtcagctagaaacaaagaatgggagtagatctcacagagactagcatgtagttagtctgcattctggctaatggaggcatcatatgagagagactagccaacagcattgtaccgcaggaagtacagctcacagatctacccagctcgcatccctcgccagctttcctacatagacctggtgctttctacagcattgcccaggctagaaggcaagtgaaagtcagcacttctctgcagagggtacatctggtccccacccagcaccagcagctgaccagggactccactaagctttgtttaagcctaccttaggccaggagacaagatcaagtccgcacatatgtgtggggcataatggcttctagccctgatcagccctgtgtagctgagcaacaacaccagagtctttagtagaccatagagctcagcacaaaggcctgctcaactatagattctaaacaacaataccatccaaccagcggagacagcctacaatcctgctggatcagagtgaactgcagagtccagttagcagtaccattcaaccttagggctcaggaagtgacacagcccaactagagaacctgacaccaagctctgcccgtccagggtcattgccagctaacacatccagaatcccttcctacgaagtagtaaagatctgtcaaagcctggaagaggtggccgtctcctcaaacacagaagcatcaatgcaagacagaagtattatgaaaagtcagggaaatatgacaccactaaaagaaaataataaagatcagataatagctctggaatataaggtgatctataaaatgactgacaaagagttcaggataacccccttaaagaagttcagggaactccagttaaattaaattaagtttgaaaccaattcatgaacaaaatgagaaattgacaaagaactagagatgataaatagaaaccaaatagaaatctgaggtataaagaatacaatagtttaactgaaaatgtcaatggaaagctttgacagcagacttgatcaagcaaaagaaaggatcactgaattcaaagataggtatattgaaattatccagtctgaagagcaaaaagaaaaagaataaaggaggcctacaggaattatgagataccatcaggcaaactaatattcacataatcggagattcagaagaagatagagaagaaggcccaaaaaggatatttaagaaaatggctgaacatttccccaatctggggaaagatgacaacatctaaatacaggaagctcaaaagtctccaatcaaattccactcaaaaaggaatttaccaagataaaacataatcaatttatcaaaaatcaaagacaaagaaacaaaactgaaagcagcaagagataagaaacatatcacattcaagaaaccacaatatgactttcagttgacttcttagcaaaaactcggcaggccaagagagattggggtgatatattcaaagtgctgaagaaaaagaactgccaaccaggaattttttacttggcaaagttgtccttaaaaaataagagagaattggctgggcagggtggttcacgcctgtaatcccagcactttgggaggcctaggtgggcagatcacgaggtgaggagatcaagaccattctggccaacacggtgaaaccccatctctactaaaaatacaaaaattagctgggtgtggtggcatgcacctgtattcccagctacttgggagcctgaggcaggagaatcacttgaacttgggagggagaggttgcagtgagccaagattgcagcagcagagcaagactccatctcaaaaaaaaaaaaagataaaaaaagaaataagagagaattccaacttccccagacaaacaaatcctaagggagtctattacattatccctgctttacaggaatggctaaaggcagttctttaagctgaaatggaaggtttctacttaataacaaaaaaaatgcatgtaaaaatctcaataactcaatggtattaagtaatacataatcaaactcattctctaacactgtatgggtgatacataaagcaatcgtatccttactgtgatgattaaaaggaaaaactattaaaagcaactgtagctgcaattgttaaggaatacaaattacaaaaacaaattaaaaattttacatcaaaattataaaaggggggagtgagagtatgagattaaagttcaattattatcagcttaatgtagcgtgttataaagctcagatattttatgtaagcctcatggtaaccacaaagcaaaaagaaaacaacaagagagaaataaagaaacagggacttacaaaaaattcagaaaatgaatgacaaaacagcagtagcaagtgcttacctatcagtaattactttgaatgtaaacagattaaattctccaaacaagagactcaggacagctgaataaattttctttttaaagaaccatatgctgcctacaagagactcactctactagtgaggacacatacagactgaaactgaaggtatggaaaaagatattcattgcaaatagacaccaacagagaccaggagtatctatatttatatcaagcaaaatcgtctttaaatcaaaaactgtaaaaagagataaagaaggtcattaaataatgagaaaggggtcagttcaccaagagggcataacagttgtaattatatatgcacccaacatcagagcacctaaatacgtaaagcaattattaaatgacatgaagggataaataaatggcaatactacaatattatggaacctcaacaccgctctttcaaaaatgtccatacaacccaaaatgatctacagtgtcaatgtaatctctctcaaaattccaatgtcatttttcacagcaatataaaatatccttaaatttatgtggaattacaaaagaccctaaagagtcaaaacgatcttgggcaaaaggaaaaaagctggtgtcattacactccctaatttcaaaaatcttatgaagttattgtaatgaaaatagcatgacactggcataaaaataagctgactgatgaaacaggatagaaagcccagaaatcaacccatgcatgtatgatcaattgatttttgaccaaggtgccaagaacacacaatggggaaaggacaatatcttcaaaaaatagtgtggggaaaactagctatccacatgaaggagaatgaaatcagatccatattttataccacatacaaaaatcaacccaaatggattaaaaatctaaacataatatctgaaactgtgaaactactaaaagaaaacagagaaaaatccccacaacattggctggggcaatgattatttggatatgaccccaaaagcacaggcaacagaagcaaaaagcaaaaagagagaaataaaatggcatcaaactaaaaagcttcttcacagcaaacctttaaagtgaagggacagcccacagaacgggaaaaaatatttgcaaactatacagctaataaagggtcaatatccaaaacataagaaactcaaacaacacaaataccatcagtctaagttggtgagccctttcaaactgcagctcactttatttatttatctattttttttgagacggagtctcgctctgtggcccaggctggagtgcagtggcgtgatcttggctcactgcaagctccgcctcccaggttcacgccgttctcttgcttctgcctccagagtagctgggactacaggtgcccgccaccacacccgactaattttttgtgtttttagtagagacggggtttcaccgtgttagccaggatggtgtccatctcctgaccttgtgatctgcccgtctcggcctctgaaagtgctgggattacaggcgtgagccactgcaccaggccttttttttttttttttactttaagttgtggcgtacgtgtgtagaaagtgcaggtttgttacataggtatacatgttccatggtggtttgctgcacctatcaacccgtcatctagattttttttttttctctgagacggagtctcgcactgtcatccaggctagggtgcagcggcgcgatcttggctcactgcaagctctgcctcccaggttcacgccgttctcttgcttctgcctccagagtacctgggactacaggtgcccgccaccacgcccgactaattttttgtatttttagtagagacggggtttcactgtgttagccaggatggtctcgatctcctgacctcgtgatccgcccgcctcggcctcccaaagtgctgggatgacaggcaggagcccccgcgcccggccccatcatctaggttgtaagccccacaggcattaggtatttctcctaataccccctccccttgccccccaaccccgtaacaggccccagtgtgtgatattcccctccctgtgtccatgtgttctcattgttcagctcccacttaggagtgagaacacgcagtgtttgattttgtgttcctgtgtgagtttgctgagaatgatgacttccagattcatccatgtccctgcaaagaacatgaactcattcttttttatggctacatagtattccactgtgtatatgtcccacattttctttatccagtctatcattggtgggcatttgggttggttccaagtctttgctattgtaaatagtgttgcaataaacatacatgtgtatgtgtctttagagtagaatgatttataatcccttgggtatatacccagtaatgggaatgtgcagctcacatttttaatttgctcagagttttcttctctttggatgcatagtcattgtctctgcttctttttctttttcagaattttcagatttgtgtaaatttcctctatcgattgccacgtcactttcattttccatcccaactttgtctcttagtatttttgctctgagacttgaaatggtccatcttttcctttgccggtctccaagccctcctctagccctgaggtaggaaagcccacaatagctctcctaccactctcaggccttcatctgcctgctgacggtccaaaaacgtcttgcttcaggagcacaggttggagttagaagtgaaattagaggcaaattagaagattgtaaactattatttccccagaaccgcacagaatcggcagctacattaaatttcttacccacagagctgattttagaaatacgtaactgcagacatttttaatggtgactgtcccgttaaaaggtaataggaatgcatgtttccccattaaaggacttgccttgttccattaaaaggtaatggggatgcatgtgtgtgtgtgtacatgtgtgtgtgttattatccaccaaaaagcagcaaaagttttttatatattttaaagaaaataataggagaagggttttgtcatgctatacttagaattctgaacatcataacttttattacaatgtatgttttaaggttaaaaaacagtattatttaatgtggtaaaccttggtaaatgacattctatttataatatatattttatattcataattatgttatactcttatatgcaatattcaacactaatataatttgttttatggtacacctggcacgtaattctctcatatcttggaggtgattcacatacatttttctaattctgtcctgactagtcttcctattaactgtttaaagaactttatactccactatggaaatccttctttttaataaataaatgtgctttatgtagtatttccataaatagttttaaattacacctggaccatgactgatacagaaatatgtacatacacacatatctatatctatatttatatgtataaacatatgtacacatatctatatagagaaatgtatttctatctgtctttcctattggatgtcttgaaactccatctttgggttcctttcttttaagttaaaacctatttttcctactaaaatgtaatgaaaaaaataaaaccaactgggagaactaatagttggcattttcttactaatttatgcctcagtgggacaatattttatcaactcttagcatggaaaaacaaatacactttggttttgacagaaaaaaaggagaaaaaacattaagcatctcaggcaagaaagggatgggaaaagcgtgatttgggtgaagcttagtagtgaagtaaatgtcacatggtagcctaagaagctgaggacaattttcacttgcatgacaatttttagtagagttgtttagtaactttaaaaacagatttaatacattttttctcttaaaaaatctacagcaagaaatccagaagccaataaaatttctatcatttcaatccagaattctttcaattgtttcaggttatggaggcattggcccataaaatattttgcccgataatgttttccaaaaagggaaatcttttctgctctcatcaacaacaaaatgtctggaagaaaaaagaaatattaaggaataaaaatttggctgaagagcctctctacttaaaggaatgaaaggtgtttcaaaaagttactaacaataagcacaaaaacaattaaacattaaatgtagaaacaattaaaagaaatatttcatgattttctgtagctcttattggcaatcaaaaaccagaaaacaaaagcagcaggggggaatgcaagaataaatgaagtgcagagaaagggcaaacatgagtaaatagtagtgaaagctttttaaaactacaataataataatatcttgtagaaatataaaatgcaataaaaaagtgtattacaacaatggcacaagggtgagagatacacaaatacatggaagtaaacttgtaaggatcttgcattctttgggaagtggccaaagtactaataagagaacatattgtgatcttgagggaaatgactaaaagtttcattacagctgcaaagctaatacaggagattcatagccaacaattggaaattacccaaaaattcatcaataaaagaatggataaacaaatccattgtatgaattccattcatataatggaagagtacataacagtggaaaggaatgaactaaaaatatcaaccaaaaattggaggaatatcaaaacattttgctaagggaaatgagcaagacacaaggtgacatactgtatgattccatttatatgttcaagaagaggcaaaactaatcaatggtgataagagattgttttggaaaggacacaggaaacttcctaggtaatggaaatgttctatatgttgatctgaatgcgggtaaagagagagaaggaggaagacagaaagagagagtcattgaataatactgaagttctgagctaagagtccttaatggatatacaaatattaaaaggagccttcttaaattgtaccacacactttaacctggattcataaagcatcaaaggtagaagggatatagagggatcatttattccaatctcctcaattttacagatgaataaacagacacagaagaatagttgctgtattagtccgttctcacacttctataaaggactgcccgagactggggaatttttctttttttgagatggagtctcattctgtagccaggctggagagcagtggcacagtcttggctcactgcaacctctgccttccgggttcaagtaattctcctgcctcagcctcctgagtagctgggagtgcaggcacatgccaacacacccagctaatttttgtatttttagtagacacaggttttcaccatgttggccaggatggtctcaatctcttgacctcatgatccacccaccttagcctcccaaagtgctgggagtacaggcatgagccactgcgcccagtgagactgggtaatttatgaagaaaagaggtttaattgactcacagttccacaggctgtacaggaagcataactaggaagcctcaggaaacttaacaatcatggtagaaggtgaaggggaagcaagcatgtcttaccatagcagagcaggagagaaagagtgaagggggaagtgccacacatttttaaaacatcaggtctcatgataactcactcattatcatgagaacagcaagggggaatctgctcccatgatctaatcagctcccaccaggtcccaattcaacatgagatttgggtggcaacacatagccaaaccatattatgccaccactagtccctgccaaatctcatgtccttctcacatttcaaaacacaagcatgccttcccaaaagtcctccaaagtcttaactccttccagtattaactcaaaagtccaagtccaaagtgtcatctggaacaaggcaagtcctttccacctatgagcctataaaaccgaaaacaaattaggtacttccaagatccaataagggtacagtcattgtgtaaatgctcccattccaaatgagagaaattggccaaaacaaaagggctacacgtcccatgctagtctgaaatccagcaggggagtcattatattttaaagcttcaaaataatctcctttgactttgtctcacatccaggatacactaatgcactgggtggcctcccaaggccttggaaagttctgcccctgtagctttgcagcatacagcccccatggctgctttcacaggctggaattgagtgcctgtggcttttccaagcacatggtgcaaactgtcagcagatctaccattctgggatctggaggacagtggccctcttctcatagcttcactaggcagtgccccagtggggactctgtgtggggcctccaaccccacatttccctcctgcactgccctagtagatgatctctatgaggtctccacccctgcagcagacttctccctggacatccacacatcctcttaaacctaggtagaggctcccaaacctcaactcttgccttctgcacacctgcaggcccaacacaatgtggaagtcaccaaggcttggggcttacaccctctgaagcaatggacaagctgtatcttgccccttttagccaatgctgcagctgaagtctccatgatgcagggtgccatgtccctaggctgcacagagcagtgggtccctgagcctggcccataaaaccatttttgcctccaggcctgtgatgggaggggttgccttgaagttctctgaaatatctcagaggcattttcccccttgtcttggctattaacattcggctcctctttacttatgcaaatgtatgcagccttcttgagttactcccgagaagatgggttttcttttctaccacacggccaggctgcaaattttctgaacttttatgctctgcttcccttttaaatgtaagtcccagttgcaggtcatttctttgtttatgcaaataagcataggcttttagaagcagccagaccacctcttgaatgctttgctgcttagaaatttcttccaacagataccctaaaccacctctctcaagttcaaagttccatagatccctagagcaggggcacaatgccatcagtctctttgctaaagcataacaacagtgacctttactccagttcccaataagttcctcatctctatctgagatcacttcagcctggacttcactgtccgtatcactatcagcattttggtcacaaccatgcagcaagtctctaggaagttccaaactttcccttatcttcctgtcttcttctgatccctgcaaactgtttcaacctctgcctgctacctggttccaaagtcacttccacattttcaggtatctttactgcaatgtcccacttctctgctaccaattttctgtattagtttattgctataaagaactacctgagactgggtaatttatttttaaaaagaggcttaattgactctcagttccatacgctgtgcaggaggcatggctggggaggcctcaggaaacttacaatcatggcataaagtgaagaggaagcaagcacatattcacttggccagcaggacagagagtgaagggggtggtgctacacacttttaaacaactagatcttgagagaacccattatcacaagaacagcaagggggaaatcttcccccaggatccagttacctcccaccagttccctcccacaacattggggattacaattcaacgtgagatttgggtggggacacagcaaagcgccaaaccatatcagatgccttgtcacagtctatcatgcaacttgtaaatggaagagccagtgctaggatccagttatcttgtatccactgcagcacttgctcagaaccactttttatgaaaaattcaaattccataagaattaaatgaaggcagaagacaaataatatagcattctaaaattaattcatacagttcataagtcagaagacaaataatatagcattctaaaattaattcatacagttcttttattccaaacttaatcttagttgtctcattaaatgaaagtttctgggttgaccactgatgaagacatagacagaagctatgaattttacacatactttgatcacattttttcctgcctgaattattagaagaataacacgtttcagtgtgcttgattgctaagtgagacagataagtgtaagattatttttcaagcaatatacttgctcatctttcaggaagcactttactcacgattacatgtgcacttagataaaagtacagtttttatcttgattgtcactcatgatgtaattattcataaacttaagaaaagaagtttctttcagcatgacaaatggttctcatgctggtgacatgacacttttgatctgttatgtgaagggaaaggtttttcttccacctacctaaaattttccccaatacaagaaatttgacagcactgaattctgtacctgacaggatgacttgtctccttgcattctgttaacctaacaatttcttccaatagaagcattcaaatgaagagtaactttgtgataaaaagacaggaagcaaagggaaaccaaggaaaaaaatcataaaataaaccacctgttagtgctaccaaaaaggttaagagatcaattccaagatttatatactaagaggaaaatatttttaaccaacttatagaatgtcataagctgccactccatctgctatctcctttcccgatttactttgcttcataggatatctataactgggaggatctacaaagaaatacaatgcattactttatacctcaaaccttttaactaagaataaaatattacatgaggcagagaaatgttctatctatagatttaatatctaaatgattttcttcaaaagccagcaacagagtaaaatttattttgtggtgacttttcattatttatcctcattttaatcaaaatcaggttgtttttcttgttctaaattactattatatatagcatttgtggtttgacaattcaatgaaaattggttttcactgaaatatcaattcaaagtttctaccagtagtatccagcgataaaatcgactgtttccttatgaactaaaagcaaaacttgacatctaagtaatcaaatgttaataatagcttggatagattctcattgttaaacaaaagcaaagcaaagaacaaaagcaaaaccaaacaaaatgctgtaattatatttgacttcacttcttacttatacatacatatatatatatatatgtatatcattggttgggcattgtttcccagtcatttattatcaaatgtttgtgtaaagtcattgatgctagcaagtcataattttaattattgcattacctctacaatttcttctttcatgttcattttaaaatggtgaaactgctatcagctaagttttttaaatcaaagtaaaaggaatctgaatcttgatgtcagtctagcctgtacctgacctgcaaactccctaaaaaggaaaaaaaaaaactgtatttaaaacttctcatgtagagtcaaggatctttttaagtcccccttcctggaatattgattacttaagtgcttttccagaatctctgagctcagttacagtcaacccttcctatccctaggttctacatccatggattcatccagtcatggataaaatatcttcaaaaattaaaaataacacaaattttaaaacagtatgtaaaacaacgatttatatagtgtttacattgcattgggaattataagtaatccagagattatttaaagagagagtgtatgtgtgggttacatgcaaatacttcatcatttacataaggaactcaagcatccatgggttttggttccccagggagtcctggaaccaatgcgccaccaatactgtgttaagtatcaagacaaatggattaatgataagctgtgtcttctctacaattctttcaccacgttttccctttagaaaaacactaaagtaagtatgaaaagctttggctctaatttctcataaattacttataatttgatatttacaaatataattatgaattataagttgatatcgtattgcaataacattttgtttctataatcatgcctctttttaatgtgattttctcgtgtattttaatatattgcagaaatgcaataactgaagaacttgttttttgtacagtgagaaatttgtatacaaagtcttctaccataataaaaaaaatgaagaggagcaccaaaacaagtaatttgccaagagtcagttttccttggattcgtatattccaattcccctgccaccaccccacacagacatgttcacatttgccaccactctctcactgcctgcaatgagatctagttagccagagatgtttttcaggctttttcagatattatgttcatgttttgacttgccatgtagcatagttaaggaggcctggctttgttttcctactgtgaaaggtttggagagtttgatgtcccactgggctgaatgaatgacagtcaattcaactttcttcctcacgtaggtatgcataagtgacttctcaactattagaaagttacttttaagtaggattcacttgagtaataaccaccttaatatttctcttcttctcttaaaaggaagagaaacatttgccatataaaatactgtatatcttattccaatatgtggcaaatttgatttttattattcatatgcaatactaaagaccctcagcaacatttcaaatcagagtttcacatgaaatatgtaaaattgccaaacttgaactgaaaggcatcttaatttcatcattgaaatgctaacttttgcaataaatattttgaatattactgaaaaataaaagagaatgaaagttggagggcatgtcatatttttatctgtagcttgaacactgcgatgatccacctcattgccataatatttttataatttaattttctcattaactctcattcactttaaaacatatttgccatgttgcacaaggataaccaaaagatattcctcagagaaggcacacacataaatcagtaagcttggagctcatgtctattatgtagttttggaattattccaaagacttgcatagtttgctacgttttgctgtaacaagaacttagaccgtactccctccagccctcaagaatgcgatgtctgccgggagcggtggcttctgcctgtaatcccagcactttgggtgcccgaggacggaggatcatgaggtcaggagtttgagagtagccagttcgagaccatcctggccaacatggtagaccccgtctctactgaaaatacaaaattagccgggtgtggtggcgtgtgcctataatcccagctactcaggaggctgaggcagcagaaacacttgaacccaggaggcagaggttgcagtgagctgagatcaggccactgcactccagcctgggtgacagagcaagacaccgtctcgtggggggaaaaagaatgcaatgtcaaaactcatcagacccatcatatgtgagttactgacctcaaccactggatttcaaaatacatataaacataagagctcgatgaacactttgagaacttcagtaagtctcagccacttctccaaaaatggagagcatattctgtgacagggttgccctgccagtcaattcttggaagactgaactcatgcagcaacagagccccaccctgtcagcagctgagctttgaagcctcgcctgcatcactggcaccacccactggtgtcaagggaccccaggtgtctttgaggatctccatggtgtcaagacaccatctctccagagaattcgcttgaaaaaaaggtgcacctcaaactttcattcgatttgcctttccacagaggcctgcttccatttctacttcaggaactagactttaatatttggaactcactccctctgtggttaatgtgcctcatcttttgagtgtattccctgtagatttgttcacattattcttctcctttttgagcattgtgaacttaagaaaacaaattctccttgcatggcaataaccatgtgatttgtgaaatcatactttgagcatcttattttaaccatacaaaacagcgtggctcagaaattcaatgtgatctttcctctggtcagtgacatatccccatgaagtgaagcagcaaggcagtaaaggaacaggggttttagttaaggggtaaaatgggtaatcttcttggaaattacaagcaactgaagagctcattccaaaatatgcagaaatctctgaaatcatacatactttttatgttagcaaaacttaagtgcaaggagtcataatttaggtttatttaaagaatgtctccagtcttgaaataacctgagtgataaaataataatacaatctttacttttatctacttgtttctctttaattttaccacacttaatatgacataaagtaaaatataacagttcttcaatacatatttttcagaactaaataacatttaagggagatatcgtgatagtcttcaaaatattttcaccttagattacatatcattattttttggtatcaatttctaatttaaagctatttttccacttaggatcctagtttttatttaaattttatttaatttttatctcctcttttttcatctattgttttacagatcgcttacaataattttccctcagtgcatagaaaggagtgagcttgacaaccacccacccccttgaaaatcaatagaagttgtcttttataataaagctctcccttatttactggagaagtgaagctaagtatacagatgcatcagcctgagtcagaaagagaagcagatattgctcagcaggaagccaggatagtgggatttccaacttcctctaggtcgttttgtgaaaggtggtatcattttatgttaagacaaattcccagaaatgttaccaccctacacacacacacacacacacacacacacacacacggaggcaaggaggaggctactgtgccttgggcacttgcctaggcattgcctgaaaattacagataattgtcactaaccaatctaattgcaactgttaaaagaaataaccctcaattcagagtatttcctattcaaatgcaatacaatttttgtttctaatatattaggttgcacagaaacactaagattgtacttaaatatggactgaggaccattttaaacattacagtaaagtagtgatcacaatttcatctggttatattaaaagtgttctggaatggtattgggaattgatttttttttttttttgagatggggctctcactatgttgcccagggtggtctctatcttctgggatcaagtgatccttctgcctcagtttcccatgtggctggtactactggtgcatgccactgtgtctgtcacattttttaaaatcataaactgattctaaattataaataaatcaagaggaaagacagaggacttactatggtgctatcttgacaacatcaaagtaactaatccccaaaagtttattcaaaaatcacaagttgtttcatcttagacccaatttctgtaccaaataaagcctattatactccataatgaaaagtacagataatgaaaagtacagagcccagtgatgcttaaatgatgccatgtaatctaatagctttgatgagtcagtttccaagatatataattatattcaaagagttctgtctggttctgttgatactacaatcaaattcttccttcgctgcagacaacaccttgtacttaagcagaagctgagtcatgccccccactatacgcctctaacaacggatatgtgaaagtcttagagctaaatgtctgagtggtcctgttttataacagatcaatagttcctgaaattagtatttgccttccaggctaaaatattttttctacagtgttccaaatattcttgcatttcttaaagtcattgtcataaatagcaatgatgctttgataatcctgataacaaactacttccaaactgcagcaacagaaggaaaatggtaggatatacagaaaatcttttgagaaatccagagaggactgatattagacataacagcaataacctgtggcttttcaagaagagaagcacatttcttcccaattaaaactaggaattctcgacagatatagttcactttcaagtgactagaattgtcgcattccttataatgtcaaatgaaatattctttgtttcctatgttcaccggctccttggtcacacttactatttgagcagaacagtccatcatacatcgagaaggcacagtcacaagcgatccctctgcgtttctctcacatctccctcggaggtgacacacgtggccatagctatgcagtgtccagcatgccctggctccactcttggagtcactgtggctctttctttcagatccgggattgtccctttcaactgcagaaaatgaatgcattccagaaagcctgggtctggtggccatttcacctgcaagggaagcactgcaaatacaaacacattcctttgtgttttattcaagatttcatcaccctgtcaaactgaggccttatggagaatagcagaaactgtgatcactcaaaaggtctcaagaacaaatataattttggaaacatacatttaatgaaatgttaagtaatggcaaattacttcatttatttatttactatatatattcatattttacttgacacataataattgtacatatttatggggtacagtgggatatttcagtagatgtataaaatgtataatgatcaaatcagggtaattagcatgcccatgacctcaaacctttatcatttctttgtgttggtaacatgaaaaatcctctctcccaggtatctgaaaaaaaagacaacacactgttgtttactgtggttaccctatagtgctgtacaacactagaacttattccaccaactaactgtaatgttgcagaagacaatactgaccacatttgtgaaatattatcctaatatgaatgataattataggtggggttttatgctaacatagctgccaagaattccataaatgaatgcccacaattgtaagcgagaaaacaagattattcaatttggtgtgtgtgtgtgtgtgtgtgtgtgtgtgtgtgtttctattctcaggcagggagttggttttagttctttttttaagaggcccaaactcatactactgtaagaattaactgcaagttaattattgcaagttgaagttatttataagactatggtatgtatgtacatacacacaattctgaattcactgtgtaatattagtactcaaaatcatatatattgtacaggagaacaacctgtgtgataattcatgagttatctcagtctctaattggacagtacaattatttactttaaaatagattagaaatcaccaacagagagctttttcttttaaactaaatgcaagcagagtaaaaagaaatgtagagtagaaagaaatgaagcaaaatatagatcttcctttgggaaaaaagtcaagacacaaaagcagttgaagaggtgtctttcatttcctagagtgatacacatatttagcagttcggtaatttttgtttaacagccatattgaggctctattggcatatgatgaacacacatgcttaaagtgcaggacttgttaaatttttacatatgtatacaaccatgaaactatcatcacaattaaaataaggaatatatccatcaccccagcaaaatattctcctccctcttgataacccctcccccataacctccctgcttccctcaaatccctggcaaccacagatctgatctctctcatgattagtttctattttccagaatgtcatataaatggaaccacacagtatttacttttctttatctggcttttttctttcaacagaattattttgaaattcattaatgtgtaatatgtatcaataattcattcctttttattgctgagtagtatctcgttgtgtgaatatagctcaatttgtgtgttcattcatttgaagatgggcatttgaattgtgtccagttttcatctgttataaataagctactatgaccatttatgcacagatggtcatatgaaaatatcctttcatttctcttgggtaaatacctagacaagaatagctatgtcatatggtagatatctgtttaacatttaagaaactgccaaattgttttgcagaatgtttgtctttatgccaaattgctttggttgattttattatggtaaactaaacttgaattactggtataagtcaattttttgaaactttgttaagatttttttgcatctgtggtcatgaagtactgtatttttactttttaaaaatgtctgtctaggttgggcatggtggctcacgcccataatcccagcactttgggaggtcaaggtgggcagatcatgaggtcaggaggtcgagaccagcctggccaaaatgacgaaaccctgtctctactaaaaatacaaaaaattattagggcatggtggggggcacctgtaatcccacctactcaggaggctgaggcaggagaatcacttgaacccaggaggtggaggttgcagtgagccaagatcacgccactgcactccagcctgggtgacagagcgagactccgtctcaaaaaagaaaaaaaaatgtctgtctgaatgtggtgtcagaataatgctggacttgtagaatgagttcaaaagtattctctcctcttcaattttctgaatgagtttatgtttatttgttatttcttccttaaatgtttgctagaaaactccagcgaagccatctgggcctggaattttttttgtgggaaggtttttaactataaactcaatctaattaatagactattcatgtcatctatttcttcttgagtcagtgttagtagtttacatctttcaaggaatttgtctttacttctaagctgtcaaacatactggcatacagctttgcattgtaatctcttattatgccttttaatatatgtaatgtatgtagtgagatcacctctctcattactgatgttggtaaattttgtcttttttttctctcattgatggcagcagctgcagccatcatgcgggctacagcagggaggcatggctgggcctgcatactccatgaagctggtgggagccccaccccttctgagttggggtatgagttccctggtgcggctgcagacccaggcctcctgctctacggagcaggctgtagcccagcccaaactgcagctgtggatccaagcttccctgtgctcttggagggggctgggaaccgacaggatctgccctcctgggtacagctgcagccacccaacccactgctgcagacctgggcttccggctccatggagcaggcaggagacggagacaagcagaagccccgccccttctgagttggctgggtgggagctccctgggtgcaactaaggccaccctcccaggcacaggaccctggcatcttggcagcctgcacctgccaccccccgctggctccgggatgtctgctctcactgcctggcctctctcctcttctggcaccctctttaatctcccaacagggttggtcgagccctggggacttgaatggcagggggagggagagtcctgggcagaagcggatgggtccccagtaaagccccaccttcaagccggggagggcctgaaggctgggagccagactgccaatcctgtggacaggactggggatctgtccctcctctgggccgccaatggctgctcatggaccagttggcaggtacttcttcctttctgaggtccataaaagccctgggctctgccagagagggcagaggacagagagacgatgggatgaccagctgcagagacgaactctcccctctactgagagcttcagagacctgcagagacctccaaatgaccagcctgcagagaggagccacactcgccagggcctcctctctgctgaaagctgaacactccaccggacgacctgcctgcagagaggagctacccactgtgggtcttctctgagctgttctaacactaaataaaactcctcttaatcttcttcgccattcctttgtctgcgtacctcattcctcctggatgcaggacaagaactcaggcaaagatgccactgtccacagaggtttctgggcaagaaaatcgacaccccaaagatcctgtaacatcatgattggctgtctccacatttacatcatacaattcaattacaaaccactgcaaagcagcacttattgatgaagagctggctcgtgagctgtaagtggacatgccatcagtggtggcaggttgtagcttagtaacttgaaatgatactttttttacattcctctctgccctcacgtggtgctaataattgtcataaaagggagtatatgactccaccatgacctcaaaaggcctattccccatcttaaaggaaaatgtcacttttctggtgctagaaattgtagatatgagagttgctcaagttcatttatagtgaagagaagttagtagtgtatttatacaagcctaacactatgaaatgcatatatttattaaatactatggaaggagccaatggcagtgatccagaaaacatatgcttttcagttgagatagaagagcaaaagaaatctctattcctattgcagagaaaaaatagtaaatatatttgctcataacaacataactaaactgtttgtggcttaataaataaaaatatagttatttaaaggtggttcaaggtttcctatataatcttccattccccaaatgtgaatttgcacagtaaggaattaaaaataaaacaaagcaatattacttgtcaattcaatcaaataactttgtaatttagcagaaaataaattgcaccagtttggtttaaagccctaactacacatctatagtttccttaaattaattaaaagaagtcatgcaattttcacagaatatcacatgcatgttatccactttaatttctcttaaaaatgggttagttgccattatcaaactttagacaagaaatcaaacagataaagtaacaatgaaagcaacttagacattagctgaagggtttattcctaattgctgagtacccatgctttatccacaaagggtgatttaccatttctataaactgatagtgagctatccaaaatggaaattaagaatacaatcccggctgggcgcggcggtcacgcctgtaatcccagcactttgggaggccgaggtgggcagatcacctgaggtcaggaattagagtgaccagcctgatcaacatggtgaaaccctgtctctactaaaaaatacaaaaaaaattagccgggcatgatggcaggtgcctgtaatcccagctactcgggagcctgaagcaggagaatcgcttgaacctgggaggcagaaaaaaaaaaaagaatgcaatccaattacaatagcaacaaaaaacttataaaatacttaggtgtaaatttaaccaaggaggtgaaagaactgtatactgaaaactataaaacactgatgaaagaaaatggaagaaaacacaaataaatggaaagatattttatgtccacaaagtagaacaattaatagtctagtttttatttttaatttttatgaaaacataatagttgtacatatttatagagtacctgtgatattttgatacaagcatacagtgtgtaatgatcagatatgggtaactgggatattcattacctcaaacatttattgttttcttgtgttgagaacgttgtgaaatacaaaataaattactgttaactatagttgccctattgtgctaccaaacactagatcttactccttctatctatctaactgcattttatatccattaaccaacccttttcgtgccctcctcccactacccttcccagtttttgctaaacaccattctgttcactacctcccatttttttagcccacacatatgagtaaaagcatgatatttgtctttctgtatctggcttatttcacttaacataatgtcctccaattccatctatgttgctacaaatgacagaatttcattctttcttctggctgaataatattccattgtgtatatataccatatttcctttacccattcattcattgatggatacttaggttgattccatattttggctattgtgaatagtgctgctgcaataaacatgggaatgcagatatctctttgatacactgagttcttatcttttggccatataccaactagtgggattgctggatcatatggtagttctatggttagttttattgacaaatctccacagtgcttttcagtgtggagatttccagtagctgtacgaatttacattcctaccagcagtgtatgagcacttccctttctccacatcctccttatcatttgtcattttctgtctttttgataatagccactttaactggggtgcaaggatatctcattgtgattttgatttgcatttctgtgatcatcaatcatgttgagcattttttcatttatgtgttggccatttgattttcttcttttgagaaatatgtctattcagatcttttgcccctttcaaaatcagagtatttgttgttgtttttttttttttgctattgagttgtttgagcatcatggtgtattctgattattaatcccttatcagatgaatactttgcaaatattttctcccattctgtaggttgtctcttcacactgttgattttttcctttcctgtgcagaaggtttttcactcgatgtaatcccatttgtcaatttttgctgtggtttcctgtgcttttgaggtcttactcaataaatctttgctcggaccaatgtctcgaaggattttacctaagttttgttctagtaggttcacagttttgaggcttacatttaactctgtaatgcattttaagttgatttttgtatatggtgagagatcagggtcaagctccactcttctgcatatggttactcagttttcccagcaccatttattaaagatactgttctttccccagtgtatgttcttagggcctttgatgaaaatcagttggctataaatacatggatttgtttctgtgttctctatttcgttcctttggtgtatatgtctgtttttatgccataaacatgctttttattttttatcactgcagctttgtagtatattttgaagtcagatagtgtgatgtctccagctttgttctttttgttcagggttgctttgtatactcaggcttttttgtgatttcacatgaattttaggcttgctttttctatatctgtgaagaatgtcacttgataggaattgtcttgagtctatagttaacattgggtagtatggacattttaacaatattaatttttctaattcatgaatatgagtttttttgttttttgtgtcctcttcaatttcttttatcagtgttttacagtttttattgtacagatcttttacctctttggttaaatttattcctaggcattttatatttttgtagctatggtgaatgggattgcttccttgattttcagattgttcactattggcatatggaaacgctactggtttttgtatgttgattttgtattctgccactttgctgaaatagttaaccagttgtaacagctttttagtgaagtctttagcttatcctaaatataagatcatgtcatttgcaaacagtgacaatttgacttcctcttttccaatgctctttatttcttttttaatagctctgtctaggactctttcaccacttttcaataaaagaaaacgatgtgattgaccacttttcaataaaagtggtgaaagtaaatatccttgtcttgttctagatcttagagaaaggatcttaggggaaagtgaatatctttgtcttgttctatgttagagaaaaggctttcaacttttccctattcagtacgatgttaaccgtgggtttatcgtatatgaacattaatgttttaaggtatgttctttctatacctaatttgttgagagggttttttttaatcacaaagaggagttgaattttatcaaatactacttctgcgtctattgagataatcacaaggttttgttctttattctcttgatgtgatgtatgtgatgtatcacatttattgatatttgtaggttgaagcatccttgcatccctgggggaaaataccacctgatcatggtgtataatcttttttctgtgctgttggattttgttttctagggtttttttttaaaagagttttgcatttatgctcattaaaaatattggcctatagttttttttgttgtgtccttgtctggttttggtatcagggtaatgctggccttaaaaaagatttggaagcattctctcccctttgatttttcaaaatagtttgagaataattggcattagcttatctttaaaagttaggtaggattcatctgtaaagccatatggtcctagacttttctttgttagactttttattactgattcaatcacattattcattattgttctattcaggtttcctgtttcttcatggttcaatcttggtaggttatatgtgtccaagaatatatctattttataagttttcaatttgttgatgtaaattgttcataatggtctgtaatgaccttttgtatttctgttttatcagttgtaatatctcctttttatctctgattctattccattgagtttttcttttcattagtctacctaaagatttgttgattttgtctaccttttcaaaacaatattttcatttggttgatctttcatatttttagtctcaattttatttatttttgttgtgatctttagtatttcttcttcctgtaattttgggtttgatttattcttgcttttctagtttcatgaggtgcatcattatatttgaaatctttctacctttttatataggcatttatttctataaactacccctcttagtactgctgctgcttttgatatataacataaattttggtatgttgtgtttctatttttatttgttttaagaaattcttaaatattctttttaatttcgttatttacccattggttgttcaggagcatgttgtattggtgcattttccaaagttcctcttgttattgatttctagttttattccattgtggtcaaaaaagatacttgatgtgattttaatttttaaaaatgtgttgagacttgttttgtggcctaacatatggtctatgctgaagaatgctccatgtgctcatgagaagaatatatacacgttctccagctgttgaatgacattttctgtaaaagttaggtttatttgctctagagtgtagtttaagtccaatgttcctttgctgattttctctttggatgatctgttcggtgctgaaagtagggtgttgaagtctcctattattgaaatgcagtctgtctctccctttagatctagtatttgctctggtgttgggtgggtgtatactcataattgttataccttcttgctgaattgatccttttatcattatataataatctcctttgtctctttttaggatttctaatgtgaagtctattttatctgataaaagtacaactactgctgctttcttttgctttccatttgtatggaatatcttcatgtgtccttacgggtgaggtgagtcttttgtaggcagcatatagctgggtctttaaaaaaatacctcatttagccactatgtatcttttaactgcagaatttaatccatttacattctaggttattattgacacgtatgaacttactcttgccattgttaaagtgttttctagttgctttgtagagcctttggtcccttcttcttctcttgctttcttctcttgtggcttcatggctctctgtagtagtatgttttggttcttttccttttatcttttgtgtatccattacaggttttgctttgtgactaccctgtggcttacataaaacatgttatacttataacaggttaatttaagctgataacagttaattttggttgcatacacaaacttttcactctaacttccttttctcccatgtttgatgtttttgatgtcacactttacatcttcttataataacaaaaataacataagtaataatttcatatacaataatataaataaaaataataggcctactcagccactcaggcctttgctgctcctccagagagggacttgcaaacattcaaagaatttgcatgccatagacaaggccaggaagaactgtgaccggattcacaaggccttcccaggccttactgggcatccttacctggtgcccacaaacagggagtacttagaacatattttctggtgcctctgatgacaggcactgctttggactggagtggaaagtagggcaccaaacccatccctggggccttcactttctagccagatgcagtcccccccccaaccaggggtcttaagaaactttctggagactcatcgggccaaccagacccatgcaacaaggtacccttctcaggccttcacacctggccccatctgagcagcccccaaagccttcctgaccactggctcccatccaggctctccccagttccatggtccattcagatttgtcctggcctccagagaggggtttagataaattttgcagggtgcctcctatgaccaatccccactcagtccaccaggtggaagggatgcccaccctggcctccatgactagttagggaatgtctcagctagctaattgggaaagagaaacgttttagggagtgctgtatgcaactgtgccccacgcaaaactgtagccatgtcagagacccttcctggaggctccctgtccagctttgactgatctctgtaggaaatacagacattcccataggggaagtaagaaactcttggagacattagttgtatttttgttttcatgtagttcaaagaattattttaatttctgttgagatttcttcttgacccttatgttatttagacgtgtatttctgaatatccaagtattttgagattgcccagctatcattctattactggtttgtataatagtttccagtgttttcggagagcaggtatggcatggtttttatactttgaaatgtgttaaggtgggctttatggcccagaatgtggcctatcttggtgaatgctccatgtgagagtgaaaagaatatgtattctgctgtcattacactaagtaggctatagatgttaattacttccagttgtttgatgatgctgtttagttctaccatattttattgattttctatctattggatctctccatttctgatagagggtgttgatgtttacaactatgattgtgaattcttttatttatccttgcagttctatcagttttttgcctcacatattttaccactcttgttaggtgcacacacattaagaattgttacattttctcagataattcactttttgttatcaagcagtgcctatattcatccagaattatcttttctctccgaagtctactctgtctgaaaactaatatagctgcttcagctttcttttaattattgttaaccttgtatatctttttccatttcctacttcaaaactatatgtctttgcatttaaagtgagtttcttgtaaacaatgtatagttgggtcttttttgtgggggatcaactcagatgaactcagtctttaattggtgtatgtagagcattgacattaaaggtgattacagatgcagttagattggtatttatcatgtctgttattattctctatttgttgtcctgtttttttcttcctatttttgccttccactcttttcctgccttttgtggttttaattgagcattttatatggttccattttctctcccatttaaacatgtaaattcttcctttctttttactgttaaaaaacctttctattggttgccctagattttggaatgtacatttaccattagtacaagtctactttcaagtaatactatattgctttatgagtagtgcaagtattttataataacaaaatatttctaactcttccctcctagtttatatcattgctattattcatttaacttatcaataaattataaacatctaataactattgctatcattattttgaacaaattatttattagctgctatatcaattgaaaataagaaaatgcaaagtttttacttcacattcatatattcattttttatattcttcctttatgtagatccaaatgtcttacttttctcttaagaacttcttttaacttattccaacatttcttgcatgcaggtctaccagcaacaaattgcctcaatttttgttttctacaaaagtctctgccaggcacagtagctcacacctgtaatcccagcactttgggaggccaaggcaggtggatcacttgaggtcaggagatcaagactggcctggccaacatggtgaaaacccacctctactaaaaatacaaaaattagctgggcctggtggtgtgtgcctgtaatcccagctactcgggaggctgaggcagaagaatcacttgaacctgggaggcggaggttgcagtgagccaagatcacgccattgcactctgcaccccagcctgggtgacagagtgagactccatctcagaaagaaaaaaaaaagtgtttaattctccttcacttttgaagactattttgtctaaggcattcatggtatcgcagtatgattctaatttgcattctcatgaatttgctattttcatttactgtttcatcatggacatttttccatgttactacatgtaagtctcccgccctgaagaaataaaccaaaacataaattaacggtactgtatagatgtaccagaattttttaaacctggctcctctgaatggctatgttttctttattttttgttattagaagtaatggtgaaatcagtattcttatcacgcatgtatttgcaccgatgttccccacacccatttgttgtcatttgactttgtcctggtacgtgcacagataaattttctttaaactttatgctatcaagttaatcaatcgtgtccttgatggctttcgagttgtctttgttgtatacatgcctttttatttttattttaagagacagcggtctatttgtgttgcccaggctggtctcaaactgctagcctcaagcgatcctctcgcctcagcctcccaagtcgctaggattacaggcgtgaacaaccgtgacgggctctgttctatgctttaaagatcttctctgttcagaaattttagaattaaagtgttttcaacaaagctttcatggttgcagtttttcatcccatacctgagggcacggtattttctaagtccgcttgcgcggctctggaaagcccggcctggcagggcgcccggcccgcaggctcgcggttacattttccacgggccagactgggaatcacgtagggagagtctgtactcttcccagcagtcagccttcccttatgctgctggggacgcgtcgtgctgacccggagctcggagaggagccagacgcgctccacccactcaggtctgagaagcgatccgacatggactactgccatttgcgccgttgtcgggctccacctggcggccgatgttacgtattgcacttgttctctggagctcccgcgagagagagaagtggccgctgtgcaccagcgtcgagttccaggatgtccctagcgttagcaggattgttccgcctgctagcaaagcattcgctccccatctgttcgtgggagcttggacctacagcttaaggtcggaggaggctcttgtcgcgctcttagccctggatgctctgtggtggggcaacatgcgggtcgaccagcaacccccagtgcctgcccctccaacacgagacctatcggggtcaacacgaaccatcttgaaagggtgtttggaggcctccccgcgtgtgtcccgataccagtaccttccatttgaccccattttcctcaagttctgcctcagaggtgggcaccggcagctgtactcagaggaccgcggagggggctccaccagcctgcactaggtcccgcgtcggtgcgcatcctcagacctgccttttccgaggcccgcttgggaggtgacaagggactggagaagaaccaggtgccccggggagggcgtctcagattctgtctgtgtggagcaggaccctgacgccacggggaggttccttatgtttttggcctcttcccacataccttaacctcttcccaaatactgggaaccccaggattcatttggctgccgaaactgtccaagctctaggctgcaggcaccaacctattccagtatagtcctttgctccaggacacctgggccgctttcctgagggaagaacattccctttatcaggcagagaccctggccacccatgccatccacaagctgttcctgccagatctgccggcactcagtcatcctgggccatcaggctactgagttccgggagatggtgagtgctcagggtgtgtgtgtggccggccagaggtgtcagagcccaaagtagctgggaagtagccagaggaaagccaagtccccagtcatctgatgctaacctcgaacttttcatccttctccttcctcgtgcattgctccttccaggcattctttaatcacagctgtgttggaggctgggattccagacccagcactaacagggtacagccacagctgcagcatctcaccgtgacctagagcctggcccagctacccaactcaggcagttcatctagcacagcatccctgggaggtggccactgtgagattcacttcggattaggaactgaggctccaaagccacaagtgacttgcccaacatcaggtagaaggattagaatttaggtctgccggcctctaaagctgtctcccaaagaatagaccattaaccaaggagacaggttatttccaggtaatacaatgaagtaatgtaactacaaagaaggatgagtaatcatggtgggggcaggatgggggggctctccctgcatctgtctcttctcttcctcctgcccccaggcccagccactgaacatgctcctggaccttgacgtgctgggcttccatgttgtcctgtcttggctcagacaccacagaaggatcactccccttccggtgataatggagttcttcattactaaagtgtgcagtcatgaaatccattactaaccctgagactctcgggcaagaggtgacaggtcagctaagtgggagaacagtagcaaagtataatggaataagatggggaggcttccaatcagagaaggacagtaaacacagacacaagctgggtggcctccacacctgtattcagttccccaaggtactgtggggaagaagacatctgcaactcagtaaaatcacatctaaatccttaaaaaggattcttctcctctatacattagtcaaaaccctcatgggtactttatccagatatgaacataaaatagtattttctgcacatctaattagcaacaattcaggaccattacaatagtccaggtggcgaggaccagtgagatcctttgatgcttctcttgaaaaatgtacatggtgccattttttgcagcatcatttggcaatatgtattaagaagctgtaaaatgtttacagcctttgacctacaaatcgtacctctgggaatttttaggaatataatattcagagatgctgacaaagacctgtgtacagaatgttcgttgcaaaccagctctgttctatgctttaaagagcccattattcacaatagctgaaaattggaagcaacttccatgaccaatgaataggaaaaaagtaaagaaaattgttggggtcgggggactctacaataaaaatcataatactttccaaatgttttagaaagaatgttgatgctacgggggaaatgagggagcttcctaatgaagcatattaaacttaatagatctcaaaggcgactctcgttttcacactcaaatatgactcttccttttcttctctcagtgaaaagcactgagatgggaaaagtccccaacttctcccagtttcccacgtcaaaaatctagaatttgttcttgattctttcctttctctctcactggacagccactgctacaatcagtcctgctggggctgtttcaaatgaatacctctgggccatccccttccctatcttcaccctcccacttcctcgtcttcctctcctctcttttcctccctccttgtcccttatctactccctcccctccttgcccttctcttcatctcccttaccctattactccctcctctccctatctgcgcctgtccctccccttcccaccccaccttaccctgccatcacttcattctcactaggtctcctctctcagggatgaccccaatgtccttctgctacttgaggggctcccagcttccttctttagcccagagccccttctgtgcccacagccagaggcctcccatggaatgtaagtccttcactcactccctgttggactccccacaagtggattccttgctacttagagcaaaacacaaagctcttcctgtggaactgagcttcgactggtgggggacataagaggcagccactggcccaaccagccaaggcctaaagctcgcagaagagaaattctcattagcagaattttcagtcgttggagctgagctgcaggatgtttgagtgtggagacctagcacaaaatgtaccaatggggggctggtccgagtcttcagtcccctaccatgctccctacctctatactgtgtgctcctgtcactctagcttccttctgcatggaatgcctcctttctattttctgtggtcacacctctgcagtgagccccatgagacccaccaacttcagaagctgcccctgacacctctagcagtagacaagtgtgtcctgtgctgtccatgcccttcctttgtacctataagctggtgactctgttctataaatagttaggtccctgtctcatcttcccagccggactgtgaggtattcatggtgggatctatgtctgatccatctcagggagtcccgtggagcttgacctaatgcccggcatgtgggaatcccagagaggaaacagcatgtgcaaaggctggagacctgatggcacctgtggcaatacggaagagtccatgtgtgtaaagggcaacaaaatagagcagtattagataaaataaatattcttgagtgcatactgatataaataaatgattaaataagttaatgaatgagggaaaggagataaatttcccatgcaggatttcaaatgaattatgttatatattccatcccaaaggagagcgagaataactccccactccttatgtgtgggctgcacacagtgacttattctccaaagaggacggtatggaagagggggaaaaagagaaactgcagtggagaatcctgatgagcactacctctgccagatctttagtgatgtcagtcatcccctttttatattcataattttctcttttttcccaatcaatccagctggagatttgtcgttttcattgatctttcccaaagaacacgtttttggattcattgattttttttcctttttttatttcattgattcccattttgatctttattattccctttcttttggttactttagatttaatttgctcttcctcatatatattttgagacagaatcttgctctgttgcccaggctggagtgcagtggcacaatctcggctcactgcaaccaccacctcctgggttcaagtgactctcctgcctcagcctcccaagtagctgggattacaggtgccagccaccatacccagctaatttttgtatttttagtagagatggagtttcaccatgttgggtaggctggtctcgaactcccaacctcaggtgatctgtctacctcgaccttccccaagtgttaggattacaggcgtgagccactgcgcctgggcgatattcttcaattagaaactgaggttgctgatctgagacccttattcttttctaatacagtaatatcataaatttcccttcaggtactgcttcagtgacaaccgacaaattctttgttgtttttctatttccaataacttcaaataactttctaatattcctttagatttcttctttgtcctatgagttatttagaagtgagttaatttccaaatatttggggatatttaaaggatctttctgttactggtttttaattttattccattgtggcctgagaacatactttgtagttgaatacttttttatttattgaggtttttaatgggctataatgtggtctatctccataaatcttccgtgcacagttgagaaaatgtgtattttgcttttatagggtggagtattctataaatataaatcaggtcaagttggttgatggtgttgttcaagtccaatacattcttgctgatttattgcctatttattctatgaagtgttgagagtgggattaaaatctctgatggttatctctatctctacttattgttttattacttttcttcatacattttgaagctttttttgttaggtacaaaaagacgtaagtttgttatgtcttcttcattaactaaccacattatcagtaagaaataatctctttaatccctggtaatagcctttgctctgaagtccattttggcattcgtatagccacctcagctttcttttgactagtcttggcatggtatatctttttccatcctcttacatctaacctatttgcatctttatatttaaactacatttcttggccaggtgtggtggctcacacctgtaatcccagtactttgggaggccaaggcaggtggatcacctgatttcaggagtttgagaccagcctggccaagatggtgaaactccgtctctactaaaaatacaaaaatttgctgggtgtggtggcaggggcctgtattcctagctatttgggaggctgaggcaggagaatcgcttgaacccgggaggcagaggttgcagtgagatcgcactgttccactccattgcactccagcctgggcaacaagaacaaaactccatctccaaaaataagtaaataaataaagtacatttcttgtaagcaaaatacaaccagcttttaaaaaaatccaatctgacaacctgtcttctaaatcaatttaaatgtaatgtaattcctaatatggttgagtctcttatcttgctattgttttctactcatcacatctgtcctttattctcttttacatctttttctgtcttcttttggatttacccaatatatttttatgattccatttgatctcctttgttagtttaatagctgtaatcttttggtttgttatcttagtggtggctccagggtttacagtgtacacctttaactgatcacggctgaccttcaggtgacagtagatcacatcatgtacagtttaagaatctgagaatagtaaacttccccccttttagtctttaagctcttattgtcatccattttacttttacatatattataaactgcatattactttatttcctaaacaattatcttttagagaagtttaaataatataaagtatatatccatgttgttactatttctggtatagatacacaatgttactatttctggtgtagaccatttctttgtgtggatccagatttccatctggtattgctacgggatccttgaggtattacttcatcagccaaaagcctctatggccagtggagccttttccagagttttgctctggatctctggtcttgttccacccactcggcctggcaggctgtgctcagttcccactatgagcctggatcgcttgtctgccaagggtaagccaggcacggaggagcaaggggtgtgtgagcaagcatggggtccggccactgcacacagccaggcatgccggctgaggggggataggcgatgggcaggcagcttcaggcactggcacgggtgccagctccatgcaaggctgcagctagaccaggcataccataagcagcttccacggctgacaccagggaatgtggtggtgcccagaaccctggagatgccaggaacccacagagccctaaagagggtgtcacagccctggctcggagttcctaggtctgggctccctgaagagccacagctcttctcttctctcttctcattgcttgcaatgtgacaaacaaggggcatgtttcagcgctgtttgtgttatagctattttagctccgccattcagcaggtctccagttcttgtcctgagaccaggaagaatgatatatgcagacaagtggaaggtgaacaagatgaagaggagctttaccgagagataagacagctcagaggagacccgcagtgggtagctcctctccatagccagggtgtcctgttgagtactgagctctcagcagagagggcagctcctctctgcaggcaggtcatcccgttgtctcttcagctctcagcacagagggtatctcctccctgaagactggcggcccaccccctaggcttcagccccaccccagcttgcaggtggggcttcactggaaacctgctcccttccacccaagagcctgtttgcctcctgtcattgttcatggcacccacgttattcatgccaaggagtacctgcaggccagtgccaagctgtcctcagccccacttcagcctccttcccatgcttgtcagcctccacagtccaaagggggccaaggggctggcatgtcagcactactccaagcatgcacacatgcagctgggatgcgaaagtgctgagagagagacagtgccccaggttgtgaactgtgacaggagcagatgctaacagtaaggagaacacggacagtgggagcaggcacttcctagcctgcagggaaaggggtgccttcctgggcccccaagagtatggagattcctgggtccacagctgcagcttgggtggctgcagctgcacttgggagggcggggctcctgcctactcttggctcccaagagcacaggagtgccctggtagcagccacagcttgggtggctgcagttgcacctgggaagctcccactctaccaactttctggctccataaagcatgcagccctagccataccactggtctgcattttccccttagtggcagcaggcaaggtgcgggtggctggtggcctcagccaaccccgcgcaaacaaacccaatgctcctggggccaccccacaagtcctggctgcactatcagctcacagactcctgagacgcagcacacagcgagattgaaggcacggcagaggttccgggcctgcagtgggtccttcccagttgtgcaagggtcggggtggtgcagtcagctgcctcagggatgtagggcacaggggacccaccactaccactgctgctcccacagccacttctgccaccaccacttgtgcctccatactgcagctggcgtgataacagtggctgctccagatggcacaccgctgccattagtatcgttttctttatgcctgaaggacatcccttaacttttcttatagtgcaggtctgcaggtagtaaagtcgttcagctttttcgagtctgaaaacttctttatttcttcatctattattctctttttgatgaccgttagttaaaccaatccattgaactttccatttcaattatgatacttttcatttcgtttctacttggtactttccccaatctatttggttattttcatgctcaagttatttcaactcctttatttctttaagtataaaacgcactttgtactgtctttggtaacttgactgtcttaagtttttgcaggcctgctctttctgtccattgtttctgctggctcttgccgattttacatttgtgattttttattgtgaacttatattccttgaaagtatctcagagtttctccaaagacaatccattttgcatctgtcagtcacctagaaggcaccaaaaagctgatattgctttaaatttgaagcttgagacattttagaccacccaggttgtgtgaacaaaccagttaaagggctatatatatatatatatatatatatatatatatatatatacacacatacacacacataaaactctcaggggagatgttttctctcaggatacccaatgttcctcactgttcctagggaagcaggggtcaagggaagcatacagggggaggcggacaggtttattcatagttcacccttacactaagtctgtccttttggatctcactttatgatgtctcctcttagcccctcccacttgggcaggccctcagctttgtctgctgttctgctgccccttttccacctcacgctgtgaaaaacagcaaagtttagtttgacaggcaaatatctgaagggtgaaaagtggcatcagtgccttagttacttctttgggtttcacttccattttaaaacttttttagctttttggaattcttattttgtagctcattgacacatttttaagaggttcttgatatgtattccagaagctttagttgtttccagctggtccttatcacccctactgttggaaataaaattctttcaacttgttctttagcaatgtacaggctccatagagctctcgctgatcctgaggcaacagggtaagaacgtcacttaggaatcaggctggcctgagatcaagtctcagatccaccagcagtgtgacatcagtgcctcgctttctttatagggttggtgatatggtttggctctgagtccccagccaaatgtcatgtcgaattgtaatttccaattacaattggaaattgaatcttacaattggaaattgattattgaatcataggtgtggacatcccccttgctgttcttgtgatagggctctcatgagatctggctgtttaatactgtatattaacttcccctgtgctcctgctgtccatacgaagatatgcttccttccctttcaccttctaccatgattgtaagtttcctgaggcctcctcagccatgcttcctgtacagcttgtggaaccatgagccaattaaacctttttttctttataaattacccagtctcaggtacttccttatagcaatgtgagaacaaactaatacagaaaatcggtaccagagaagtagggcattgttacaaagatacccgaaactgtggaagcgactttggacttaggtaataggcagaggttggaacagtttggaaggcttataagaagacatgaagatgacggctgggcatggtagctcatgcctgcaatcccagcactttgggagggtgaagcaggtggatcatttgatgtcagggtttcaaagccagccagaccaacatggtgaaactctgtctctactaaaaatacaaaaaaaaattaggcgggcatcatggcgcatgcctgtaatcccagctactcaggaagctgaggtaggaggatcatttgaacccaggaggcagaggttgcagtgagccaagattgtgccaccacattccagcttggataacagagtgagactccatctaaaaaaaacaaaaacaaaaacaaaaatgaaaacaaaacaaaaaaacagaagacaggaagaaaagtttggaacttcctagagacttgctgaatggttgtgactgaaatgctcatatagtgatacggacagtgaaatccaggctgacgtggtctcagatggaggtgaggaacttattgggaactggagtttgcagtcactcttgctatgttttagcaaggagactggtggcattgtgctcctactctagggatctgtggaacttcaaactttagatgatttagggcatctggcagaagaaatttctaaatttctaaacagcaaagcattcaagatataacttggctgcttctaacagcatatgctcatatacattcacaaagagatggtctgaaattggaacttatatttaaaagggaagcagagcataaaagattggaaaatttgcagcctgaccatgtggtagaaaagaaaaaccaaatttctggtaagacattcaactcagctgcaggaatttgcataagtaaagaggagcagaatgtgaatagccaagataatggggaaaatgcctccagggcatttcagagatcttcacagtagcccttcccatcacaggcctgaaagattaggagggaaaaatggtttcatggcctaggcccaggaccccactgttctgtacaacctcgggacatgtcaccctgaatcccagctgcttcagctccagctgtggctaaaagggccccagatacatctcaggccactgcatcagagggtgcagccataagaagcctttgtggcttccatgtggttttaagcttacaggtgcaaggaaggcaagagttgaggcttgggagtttccacctagattttaaacgttgtatgataatgcctggatgtccaggaggaagtctgctgtagggtcagagccctcatggagagcctttactaaagcagtctggaggtgaaatgtgggtttggaggccccactcaatgtccgcactggggcactgcctagtggagctgtgagaagagggccactgtcctgcaggccagagaatggtagatccattgaaagctttcactgtgtgcctgaaaaagccacaggcactcaatgccagcccatggaagcagtcactggggaagtaccctgcagagccatggggcagagctgcccaaggccttgggaccccaccccttgcatcagtttggcctggatgcacaccatgagcagtaatgggaaaattcttattgaaaaaggcaagaacaaatcagcccagtgagatgaattacatgttgcactccttcctgggatggaagaattgaacaatgataggatcttctacatttcggtttttacttttactgactcatgggcagtggccaatggcctggccatgtgaccaggcagagggacaatggcaaactgggctgtgaaaggatgtccacatggagcacagcactgcaggaatttaaagggcacattaaagtaggtcatgtcaatgcccacctgaagaacccctcccaggttcagtgatcagatctggtaggtggatatcctggtgaccttgaggtggccacctgggcttaacaaaggagtggacaaaggggagctgcagccgtgcagggatgggctgctcagcaacacgtccctcctccaccctcagaagcaccaaatgccaacaagaaccgtcctatctgacagcaggaagacagagactgcaggtggctatggggcagattcccagtgggaaggcaccactcatagctaacaagtagattataccagactgaagccagtatccctgggaggctataatgggtcctgacacgttctctggactgggctttgcatagtcattagattcaaatgccaaaaatactataaaagaactggaacagatgataagacatcaacttggaccaccaagttttatttcttcaggccaaagaacacatttatggcccacagtgtcctataatggacataccatgttgcatattgtcttcatctcctagggctgccataaaaaagtgccacaaaccatatggctgacttacaaaacaaaatgcactgtctcacagttctggagactagaagtctgagatcaagttcttggcagggctggatccttctgagggctgtgaggaagaatctaatccacacttctctcctagcttctggtggtttgctggcaatctttggcatccctgggcttgtagaattctgccttcatcttcatatggcatatcccctgtgttatctctgtgcacaaatttcccttttttataaagacacaaatcatattggattagggggcccaccctattacagcatgacctcatcttaactaattacattaacaacaatcccattttcaaaaaaggtcatgttcttaggtactgggggttctgagttcagcatatgaaatttttatttagggtaacatatatcccttttttcagtttttattgtgttaaaacacacataaaatttaccatcttaaccattttaagtgtacaattcagtggtattaaatacattgataatgttgtagaagtatccccacaacccatctgcaaaactctcttcatcttgtaaaactgaaatgatatttattaaaacctaacccctaccccctcttcccagcctctggcaaccaccattctaccttctgtctatgaagttgaatattctaggcccctcatttaaatggaatcatgcagtatttgtttttgtgacaggcttatttcacctagcataatgtactcaaggtgcatccatgttatagcatatgtctatatgctatatagacattttcttccttttggaagctgaataatattccactgtatgtatgtatatgtcagattttgtttttccattcatccctcaatgaatgcttagattatttcccttttggctattgtgtctaatgctgctatgaacacgggtgtacagatatctctttgagaccctgctttcaattattttggtattccacccagaagtggaaatgctggatcatagggtaattctgtttctaatttcttgaggaatcaccatattgttttccatactagatgtacggttttatattcccaccaacaggaatataagcattccaaacatgaattttgtgggaacatatttcaaaccatagcagtcaccaaaagctcaagcaacaaaacaaaaaatagatcagttcaatttcattaaaaagttctgtgtttcaaagttgacatggtttggctgtgtccccacccaaatctcatcttgagttgtaactcccagaattctcatgtgttgtgggaggaacccagtggaaggtgactgaattatgggggcaggtctttcttgtgctgttctcatgatagtgaatgagtctcacgagatctgatggttttaaaaatgagagtttccctgcacaagctctcactttgcctgctgccatccatgtaagacgtgacttgctcctccttgcctttcatctttcgccatgattgtgtggtctccccagccacatggaactgtgagtccaataaacctccttcttttgtaaattgaccagtctcaggtatgtctttatcagcagcatgaaaacagactaatacaaaggttacataagaaaataaggacaaccacagaatgggacaaaaacttataagtcctatatctgataaggaacacatgttccagatgatataaccactcttacaactcaataaaaagacaacgcaatttaaaaatgggcaaaagatgaatagacatttcttcaaaaacatgaaaaatggccaataagcatgtgagaaggtgctcaataacattcattattagggaaatgcaaatcaaaacacaatgatacaccacgtcaccccaatgagataactaaattcaaaagacaaacaataaggagtgtcagcaagaacaggaaactggataagaaccttcattcaatgctgagggaatgtaaaaccttgtctgttttggaaaacattttggtagtttctcaaaaattaaaacagagttatcatatgatccagtaattacactccaaggtatatacttaaaagaaatgaaaccacacaaaaacgtatacctgaatgttcacagcagcattattcatcatagccaaagtggaaacaagaccactcaagccagccctgcctcggaacctgacaaagttaaatggaagcctacacagctgagccgcatttccatgggagacattttggtcattccaggtgatgatgaactacaccaattgttagtggctgacaagaacctcaggaatgtgccagcatcttttgacttttattttggggggctgcatctactaccacaacatgcaatatgggtaacactggcatggctggttagatttgattacctcatgcaaataagtcatgtggtaatactgatattgatgatcaaatgtattgggagattgagttaaagtctcctcaggatgtaataccaacggaaaatgagtctttagaagaactatatttagttaaccatcacctaatttccagataaatagttctgcacaggtcatataagatacaaagagcagtagatcaagggggaggatgatcttggggactcctgaaatatactgtcaataacccagatatcctccagtaaatacatggatatacaaagtgtggtatacatacatatgtacatacagtggaacattattcagccataaacaggaatgaaatactgatacaggccacacaatgaatgaacctcaataaaccgtagaatcctgctaagtgaaagaagccagtcagaaaagaccagatattggatgacacatttatataaaatgtccagaataggcaaatctagagacagaaagcagattcatggttgtcaggggttgagggaaggaggaaatgaggagtgattaagtgaattaatgcatgttaacaccttaaactttgggcaactgcccaatcacacagacagtgcagtctcattcatgggctacatgacaaaacaaagagaaaagcctgggtagaaataccaacatgtatgtcacgaaaaatataatacctaaataaacagagaaactatgttccttaatgagcaaattcaatattataaggttgccaattctcctcccatagtttctcaaaagttgcaatgtaatgcaattttaatctaaatggcatggttatctagacaagaaaaaaattgattgtaaaatttatatgaaataataaaggtgtgagaattgcaaggaaaattttcaaatggaaaattattacaggagaaaggagtgtggagaccttgctctgtatggtagaagtcaaagacagctaccatcaattctttcccttcctcaacacacattgcttctcaagaggtgaggaatagctcccttccccttgaatctggctgccttgcaacttgcttgatccatagaaaatgccataaattccattctgggaattctactattggatttttttttttttgagatggagtctccctctattgccagtcttgagtgcagtggtgcaatctcagctcactgcaacctccgcctcccaggttctagagattctcctgtctcagcctcccgagtagttgggactaccggttcacaccaccatgcccagctaatttttgtatttttttttttattggagacgggtttcactatgttggccaggatggtctcgatctcatgaccttgtgatctgcctgccttggcctcccaaagtgctgggattacatgcatgagccatcgtgcctggcccgattttttttttttttttttttttttttaagaaactgaagcctctacttcggtctcttggtagccttcctcctgggaagctctttcttgaatctagtcaccattccattccaccacgccacatatgtcttctccaggcaacagccaacatctattgtcagccatgtaagtgagtttcagatgactgtggccccggctaatgtttgactgtagcacatgtgagaggccccatgcagaaccacctagaaacatggagagcagtcaccctgcagaaccatgagtaagttaagcttaggggtggttaattacgcagaaataagtaaacagagcactccaccaggtattaaagattattacaaagattatgtaattaaaacaatacagaacagaccagggttgactacaagatcaatgggacagaataaagttacatatccaatgcctgctgctgaccacagggatttgtcacagatctcatcacttagaaaccctacagtggtttccctggtcaccttccagtcaccactacaccttggctccttttagcactcctccctagcttatcactatatgaaattgctttatctctttgtattgtctgtcacctgccaccataatgtgaatttctagacctccatagcatgcaaagctctagaacagttctttgaacacagaaggtgcttgacaaatattttctgaaagaaaaagaagatacttcaatacctcagtttactaaggacgtggggctaccatatggctgcctgaacaaatacagcttgacattcactttcttgctactgattgaagtgtattaacttgtgtaatcacacaactaccctatggggtaggtgcccttatttctccatttggcagagagggactaagtatcttaaccaaggtcacacggctttcaagtgccagagccacgactcagatctacacaggtctggctccagagcccccaatctaacctcttaacctctctgctttactgggctaaaccttcaccacctatcatatggaaaaagaaattcaatagaaagttatatggaaaaaatacaaccctgtgttaatattagaaaatccatagtaacatgtagaatgaggaagcttcctcaagcccaactatacaggtcagatcggttgaaaaaataaaactaacaaatttttacatgtcaaaatatgcaatatttgaaaatccaaggctaatatctttaaataggcaaagatttattaataccccttgacacacaaacaggaagtgagaaaatgggcaactgacacaaatcgataattaactgtgaggacataggtggtggagtctctcctaatcctctattcttggagatctgaatgcctgccattcccgtatgggaagaacagagacggtcatggaaaacagcatttaatctagaaaggaccacaatgaggtcaaagggcggtctcagggcagtcttaagagctccccatccccaaagaactggcaaggactctccaggtgctcgtatgcgactgctgcccaactcccatcacgaactcagaagacctgtcattttctgaaattttcatgacttctaagacactagttattggggaaaacttcaaattatttaaataatgagaggcgaaaaacattgctaaactcatgaatactctgtatttaaaacctccactggcgatcagggcacatagaatctctactactgatccctgacgctggccatcccccaacccgtcggcccacggaccccagccctgaccccacctcctcccagcatcttacacaaggattctcaccacactccccagagactcgcctgcccagggcccctctctaaccccatatagctcaggtctctgatccagagactgcatcaccgacctctccgactacctatttccagattagagtccctgatcccagaggcattgtctaaaataactagctcttacaactacgtccacttcaggaaccgccctgtgatgtcagaactttgaggccgcccggccagggctgcacatgctcagtgaggtcggcgcccgccagtaacaaacatggctccctgaagccgctcaggctcaagagcaacaaggaggtctgcacttaatcgctcctctccgggggcggccataccgaggaggcgtctcttccgtgcaggcaggctctcctggggacctcagagattctctccagcggcagcggaaaacgggcaatgggtggattcgggtccagattctggcaggagggagtttgggatcgagatctggaaaaaagcactagactggaagaggacgcgatggagtcggagccgctggcggggacaaaaaccagaggccggggaaggcgccggtgggaggcaaggcgcgcatagactttacctgcgcacgcgtcgcagccatctccgcccacagtggtggccaccgccactggtgctgaagtgtcggcgtgtgccgggcgctccgctgggacccgggttgctggccctgagtctcagctttctcatctgtacggttgggacaagtacagtaaccctcgcccgtcaagacgggccagggctgtggcgagggtccacgccttagagcaggcacctatcttgtgcagggccctgagatggggtctgactcagttcctgcggggaacttcaccagtgacccagtcagtgcccttcagttaaagactaccaggggcacacttgtaattaaatataattacattgcagcaaggaatggggtactatgggtcatctcagtgggaggagttagagagaaactattatacgatttgggctttaattggttgatttcggacaggatctcagaaagtgaagactttagattggatgctgtcagaaagcaggagcaatatgattattaagtattttgtgggtgacatcaagaccttgttttttatctgcacttagacaacattataaagtgcccttgtttttgtttgcacttatcacggtctcagattaaccttctgaagttgatattctgtgagattgtttatgtccaacaggaaaacaaaatgtcctggccatgagcatcagaccagcgtgtaatcacattaaggcctgtgacccaaatattgacagaattgaagttagaaatagttctacagtaacagagtcttcaatactccatttaaaataatgcatagaagctggacatggtggctcatgcctttaatctcagctacctggggaggctgcggcaggtggattgcttgaggtcaggagtttgagaccagcctgggccttttggcctgtctcggcttttaacataccttcctcactcagcttaatcatttctcactttagatttataataagagatgtgtgactcttactttcacttgaacacatagaggcctttatagagttattaattggcctaatttcaatattgctgtgtctcagaaaacagacctgaggagagggtgagatggaggaagggcagatcgatggaaccattcgaatacacatatgtatcaattaagctcattgtcttttggagcatggcttgtgatgccccaaaacaatgacaatagtaatatcaacgatcactgataacagatcaccataacagatataataataacaaaacatttgaaatattgcaagaattacaaaaatgtaacacagaggtgcaaaataagcacatgctaccagaaaagtggcactggtagacttgcttggtgcagggttgccacaaaccttcaacctgtacaaactgcaatatccgagaagcataataatgtgaagtgtaataaaacaaggtaagcttgtatatgtatgcatgcacacaccagtacacatccacctatccacacacaaatctttgtactaacaaagcctgtattttcaattccaacaatacatcatttgtaccttaaaaatctctgtcatccttgtagtgtccttttctgtccttgttatcagggtaatgctggcctcataaaaaatgtttggaagtgttccctcctcttcaacttttggaagagtttgtgaagaaatggtattaattcttctttaaacatttggtagaattctccactaagctatctggtcttggattttcctttttcaggagctttttgactactgactcaatatttttactcattatttatctgtttttattttctatttcttcatgtttcagtcttagtggatgtatgtttctagaaattattctaagttaaacaatttgttgacacatagttgtttagagtagactattattatcctttgtatttctatggtaccaattttaatatctccttttttgttctaattttatttacttaagatttcttttttcttagcctagtgataggttggtcaatttttattatcttttcaaaaaatcagctcttcgtttcattgatctttgctattgtttttctagtctatttcatttatttctgctatgatctttgttatttccttcttctaattttgggcttgattttttttctctattttttgaggtttatttgagatcttttttcttcatttagcacttatctgtataaacttccctctcttagaacggcttttgcttcatctcatcagttttagtatgtcgtgctttcattttagtttgtctcaagatattttatttcttttttgatgttttctttgatctactggttattcaggagtgtgttggttgatttccacatatttgtcacttttctaagttttctcctgtttttaattttcagtttcatgccactgtagtcaaaaagaatacttggtgagatctcaatcttcttaaatttgctaagacttgttttctggcctaatatatgacctatgttggagaatgtactgtgtatgctcgagaagaatgtgtattttgctgttttggaaaggaatgtcatgtatatgtctggtccatttgatctatagtgtagttcaagtcagctgtttccttactgattatctgtctgagtgatcaatccattgttgaaagtgggacatggaagtcccctactgttattgtattattgttgtctacttctctcttcagatttgttaatatttgctttatataattaggtgctccaatgttgggagaatatatatttgcagtagttatatcctctcaatgaattgacccttgtatcattctataatgactttgtctcttgttacagtttttgacttaaagtctattttgtttgttgtaagaatagctactctgtctttttttgttccctctctttcagtctatgtgtgtctctaaaggtgaagtgagtctcttataggtggcatatatttggttcttgttttactatccattcagccactctgtgtcttttgtttcactaatttggtccactgatatttaaagtaactattgataggcattttgtagtttttttgttcttttatttctctcttgctgtgcatgatttgattacgttgattattttctgtagtggtatactttgattctttgctgtgcctttgtattaattcttttttaaacatgtggtaaaattctcatttgtgtatctgttacatgttttgtctttgtgtttatcatgaggcttacataaaacattgtatgctatcgtgtgccacacaaggatgttttggtcaatgatgggccacatatacaacggtggtcccataaggttataagatttttattgtacctttcatatgtttagatacattagatacacaaatgcttatgattgtattacagttgcctatagcattcagtatagtacaatgctgtacagatttgtagcctggaaacaataggttataccaaatagcccgggtgtgtgttaggtggtattatctaattttgtgtaagtatactctatgatattcacaccatgacaaaattgcattattcaggacatgtccgcattaagaaatgcatgattgtagttataatggtctattttaagttgataacaacttaacttcaatcatatacaaaaaccctacactttactcccctccacttatgttttttgatgtcagagtttctttctttgtatattttgtaattatatttatttgtagtattttttgtcttttaaccttttaaaagttaaagtgattatactccatcattacagtattaggagtattttgaatttgactgtacagttacttttaccagtgactttttataactacatatggtttcatgatactaattagtcttattgcatttcagtttgaggaactccctttagggtttcttataaagcagatctagtgacagtggactcccctagattactttggggggtttctgaaaaagtctgtaagtcctagccagagcaattaggtaagaaaaagaaataaaaggcatccaaattggaaaagaagtgaaagtgtctctatttgaagatgacatgatctgtatagaagtggaataaagagtagctgacaacaatgctgaaatagttacacatgaagttttaatgagctatttcatattaagatacatattgagaattcaaaccagagagtccagttaattgatattttcccaactctgttttagggtgatcatagaaatgatatccacaagttagtcacagtggcctgcatccattttgatatatcagtgatgtattttgattggccagtgatcacccatactgactgttaaatatttttgttatcactcctatgcatggtgaatttgagttctggttttctttagccttgtgttatttatgtgtaaagttggattatggaaggcaaagaatctctcgtgtgtcattcacgctcaagtaaatggcagtggggtagggatgtaaatgaaactgcgtgataagccctgcaagtcattctgatgtatcaattttgcttactggtgtttaattgcagacattgtcatattaatgcaaccactaatacattatggagtaagatgcaaaaatcacatgagtcttaagagaaaagaaatgtgctttctatggtgggccccttttgtattattctctaacttcttattttatacctctactattagagaaatttcagtagaaaatcgtgaggggcaccgttttagagtttttgttgttataggtatgcttttactacagctaggtccccttgtacatctttatgttctttggcagtctagagaaccagaagagcaaactctatgagatagaaactctaagaatttatttacctccagcatcccttctcttctttcattaaattgaatttgtggccaactcaaagactgacaatttatactatggtttttatgtttttatattataatttatattacggcttatgtcaaaatgttttgttcactgctttgaaagtatcttttgtttacttttgttatttcatattttaattttttcctttctaattgttagaaactcatgtattttatctttcaaagaaaattttttaaaaggcttactctgcttatatgtatattttgcacaaagctttccattcataaacaaaaggtgaataggaatcagaattgaaaactacgtaatttcttttctccttttgagtcaaatcatcacagtatagattagtcattgtgtatgaagtgcattgccaatacatagtcacatttgtgtagaaatgtaaaggctatatctcaatacaaatcaaaaaccaaaaaatgcagaagaccattagctaataatactaataatctagtatagaaagcatgtgccaactgatctagactcttgtgacagttgtatatctacccagctgcatgacctgaggtgtatcaaaatcttgatttcctagactacaaatgagtaaaagggatggaggccccttacagttttaagattctagaattctaagtgtgtgtaactagagcaaattttattttctaaaatttgcataataaatttaaaaataggagaaaaacaaataattaaagtacatatttctagaaatcttttttaggtgacttatactaccaggaatggatttaccactaaatattggttttgcctaattcagcattgctatgtaatttgatggaagtataactccatagacaaagagatttggtcctaacatagcttgtattttatatgtatatacactatttctatttaaatttctgtgtagtcatgttttacccttttaaaatgaagattagttttattatgtattttcttttgtctataaacattcaatgaattcacactgaaaactgattatgaacagatagtctgctaggcactaaggaaacacatacgaaaaactaagtcctcctctgccctcaatatgctcacaagactacagttactgaagcctgacctcaaaacctagctagcaaagtccttgaatcaggtgatagttcagaataccattcgtgctctctcccaagagtatatctgaggaagggcagttctttctagttttctacatcctggtcgtataggtcaaccacaggaaaattaaatgaatctattgttttggtgacctagccttttcatataactctcatctataaatgtattaccaaatactatttatgtaaagggacttgtatgacaaatattttgaaattaaaaccacaatggttagcatagcttttaaattagatagatgttgacctcccattggtaaacatataaagtgctaccaagatctgccaatgacagactttggaagtggaaattcatctttgtaataatcctgttatctgtaggctgacctcaaaccttcataacattcagggccccttattcctaactgtatcttctattttgggcattgtgctcttgccatctaacaggaaaacaactttcagtgctgccaccttttgaacaggagagatttctagagattagaaaattactaaatttaaatatacatagttttaaaatatgatacttttctacccatgcattcaaatatattctaactttaaaatcctgtaaatacttatatttgtaatgattttacttatatgatccaattaattggcaagaatatgtggtgaaagattttttacatgtttgtattgttctgtgtgagacatctattgtaagcattgcttcaggccctcatttttgtctgccttccaggatttgctggcccaagtgctgtgtgctagcttagtgtcagtcacaaaggggagggaaacttgcagttgagccagacagttttgttattcctttaaaattaaaagcatatgaaacagatacagcttattaaggttttttttataaataacataaacttaaataacaaaacaataagttcaaaaacaacttaatatagagtttaatgcagtaaccataggaaaaaagcgtgattatttgtgggaagaacattattaaaagccatattcccaaatatgaattatacaaagatagattatgttacttgaaaaaaacttaaagatttctcaattttactttgaggaattataaaatgttatttagtggcaagtaagatgaagtacagtattatcatcaatcactgttgctatcttatatacaagatttttggaaacatccttttagcaataccctttccacttgagcagcattagaaattttgttcttgttaataggtataagcatgttctaatcctgtacttttgttaaattatctattttattgactttcataatagatttttttgagaatattctttttttctgattagagtttaagtagattataatttttcactagaaagcatttaaaatgctgctcattttccatagttagtgtggcttgattatctgacaaatcctgccagcagcctgtaggtctgatataccttatataacatcatctgcattattattattatagcagccattttataagcagataggaatatttaaataatcattatcagataatcaaatctaacatactcttaagggtaaattaatttaagaaaaaaattactattactaacatcatgattgtacaaccagttttacaattttgtacaacctttagttactaaatctgatttttgtgtatacttttcaaatgtctctttaatgcagtgtcttaaaacaaacataaatgcgcaagtccagcttgatcagtttttcagtagttttccagcctttcttgattactagaaaataaaaggaaagaaaattttgagaagaaagaaaacagtccacttaaagaaatctccctgctggaactggttctttatataccatatgcaattaagttattgccataggaagaaagtgggctgttttttgttctttctttgttttttttcctcttacaggaatccccttttgatttaaggccacaaacatttcccctccgttgtttgtccatttagctgctgcatatgtgttgtaatggttttccagaattagatctttgaagttacaatcttcattgcattccttctgttgaaacaaacaaacaaacaaacaaacaaacatgatccaaatgattttgagagaggctcaattaaacgaagagtaagcaggtaatatttggtagaattgaaacatacacaactttttttaaccctcagattgagcaggcctaatgtggtttattagctagacttatgtagtatatttgcattaaaaggtatcttaaatttgaaatagaaacaccacataatacacagctagttatgaaatatgtgtagctttttggaagttcatgtcaactattctttaaaattaggacctatttccccctaagtaacaggcctcatattactattcccacatcactcattctttaaccactggaaatttgctataattagcagaacctctgcctccctcaggtgagagacttgtttcacaacttttctttatttacttctacattgtcttcaatggtaatggaagataaaaggttaatttgtttgttcatccatgcaaccatttgttcattcagttaaacctgtatcattatacaattagcctgttccaggcattatgctgagctgtgggaatataaaggaaagccaattatattttattacagtgagatgaactgttacatattttgcattgtagtgaagtgggaacaatgtgaataattacagttcaaagcccatgattgtcagattgatattgatgaatgaactaaacatttcaagattttttcccaagaattctcatgtcagcaatgtgcaaattgagtgaactttaacaaaaagagctttaatactggcaaatggaaattttggattttaaatatctaaaatgcacatggaattttagagctggcaggatccttagaggtcagctaattcaactcattttacagatgaagaaaccaaaatccaaagaacaagccatttgtccaaagtcacacagaaaacattttttcttaatgtttgagtataaagtgttttaataaaatcattaaattatacagttggagataaattaagtccatttttacttttcagaatggtgagatatttcaacaaaagagttttaaaaattaagcctaagctatcaattatcaatacctttgcatagagttttccttcctcgttcgttgcaagatagaattcactttccacccctttgattgccacaatcccaactgctactgtcctgatttccatgatatctgcaaggaatcacagaaagacatgtcaagtattcgttcagctttgcaaatgatccacgaatggccgtttgttcttatttctgttttaatcggaagtttttaaaatttttaatgtgattatttactcagcccaagaccccgacccacaacagatacacacaaacaccagaatagtcattatataagggaagtgcaaactgacggttttttattttgtagaaaatatgtctgtatcaaataaatagttacatatttgagttcagctttttattctctagaattaaatttctaatttactataataataatagctaatgtttattgaactcataccacatgccaaggattattgcattgctcttatgtattaactcatttactcataaccacagattgaggcaggtagtcttgttatcccagttttacagatcaggaaactgaagcacagagaaactaagacatttgtccaaattcttatacctgataagtagcagaactggaatttgaacccagacattctggctcttaatcattatataattacttttctatttggataaactttatcttaaaaattattgccaacagaatagctcttgaatatactgaaagtgaagaaaattctaattaaagtaattgtaaatgatggtaaacagagcctactgccttaaaaaaaaaagattgttttaaactgatagtattttgatacatgaaaagaccatttaaaacaaaattatgaatcctgtttatataatacttcataactttatatctttgtaattaacttttaaatctttgttgaaatagtatttacaaaacatgtttacacaagaatgataacttactattttcctttattatatatatcttccttaaatcctgtgttttaatgacacaataaagtaaaatctcaagaaatttattaaaatgatgtaaaaattttagtgtacttttatgcaatttgctattaattacattttctacatgaaggtacagtcctgagacattcttttacctaagtctaacacagtgcaaagaaaagtcgaagtgtcaattatctgtgtgattgggccttcaaaagctatcttctaaaatattgacttaaagaaaaaactaattgttttgccccataccttcacttcattctcttatttatttttttgacttcatttttgctacctggataataaaatttctattcatgtcattgggatttaatgtagcctagctaatatttctcatttgcctcacatatatgttgcatacagaagcccttttcccaatatactatacttaacactagtcagagctcgtccagttgagtttcacagctactcatccagaaattgggttttattaagaaaatgtaaatgaatggatattaatctttttatatatttattaagcattatcacaaccctactgtgcatacaaccctactgtggttttaggacacaaattaagaaaaacagccctggtttctgacaccagaagttaaaacctaatagaaagagcagacacgtccatatattttgaagaattttgaagaacacaggcctgaataggccagataaaattttaataattgcttacaagcacatgaaggattatgatgttgatgcattcatgaaatgttcaacaggtcttcactgagagccaattttatgctaggctcaattcacagacaagccttgcccttttagagcactctatttggtaactacagcttcattgcattaaaggaagcacaaagggaaataacatgcagaagaatactattaggttaaatttgtacgaatacaatgaaaaatactgaagaagttcattgattcagcatatttgcaatacctccaaaatggaatgaatgtatcagttaggtcggtgcaagagtaattgtggcttttgccattacttatatgacaaaaactgtaattacctttgcaccaaactaatatttaaaagacatatggaatagttggtttctaaagatcttagcattgtaaaatatcattaaaaagtcaatattttcttttccttcaagtctctttactcctgccattcctccctttatttaatatattttcttttagataaaaagagaatgctgatgcacaagcttagagtgtctttcttgatcagttattagggactagaatctgtaatgtttgctggcttttcttttacagaacaattgtaaaacataaatgttgactgatagagttattattaattatgataggcagacatcttccctttttggtcctgtcatgacaataagttcatattgtcccactcccaaaacattttcctctatcccctgcctgtctattacccactgtttctatactgcactttacaagaggtgatggctggatgtggtagctcacacctgtaatcccagcactttaggaggccgagtcaggcagatcacttgaggtcaggagttcaatactaacctggccaacatggcgaaaccccgtttctactaaaaatacaaaaaattatccgggtgtggtggcgggtgcctgtaatcccagctactcaggaggctgaggcaggagaattgcttgaacccagaaggcagaggctgcagtgagccaaaacggtgccactgccctctagcctaggcaacagagtgagactctgtctcaccaaaaaaaaaaaaaaaaaattagttgggcatggtggtgaattcctataattctagctacttgagaggctgaggcaggagaatcacttgaacttgggaggcagaggttgcaatgagccgaggtcacaccacagcactccactctgggtggagtgaggctctgtctcaaaataatagttaaataaataaataaaaataaggtggtgaacatttttaatcttatccctccacatattagggttaaggataccaaaaattcttcgtaaagattctacatttggctgagatgagaacagacttatattcttaattgcttgacatatttaaaaaataccattcacactgggaaatcaacatatctaaaagacaattgcttggggagagcattaagcagtgttggcagaatcagtaccttatcgaccctattttctagtctattttgttccatgtcctacgaccctcttttattcaagaaaagctcaagaataaagaaattaacattatcactcttttgttcagttgcagtgtggggagtgatgttcctttcaatatgcacaaatatttatagaagtgttaaatatgggctgggcgcagtggctcacgcctgtaatcccagcacgttgggaggccaacgcgggcggatcacctgaggtcaggagttcaagaccagcctggcaaatatggtgaaaccccatctctactaaaaatacaaaaattagccaggcatgatggtgggtgtctgtaatcccagttactcaggaggctgagtcaggagaatcatttgaacctgggaggcggaggttgcagtgagccgagatttcaccattgcactccagcctggacaacaagagctagactctatctcaccaaaaaaaaaaaaaaaaaaaaattattaactatgaaatcctacccctccaaatcagaagccacgaagttgctcagaaaacataatagaaaaatatgtaatatgcagatattaagttagttaccaatataagttaattatacttggtttttttgtctacagtgtatccgttgcctcatataaaacaaatagaagaggctgtctttctttgtggatttccatttgtgcttaagagaagtttgttcacataaatagcactcagtaaatttattcccagagatttaaagcatattacatagatgcatccaattgttgacataatgtccatgataacataatgacagagttcaaaaatataaatgaaaaagagagagagaatcagctcatgcaatagaacatgaaaaaccaggcaatatgtcaagcacattgaccattttgccttgttagcaatattgtcaacaatagcataaatttattatttaggatgtcacccttacacactagagactatgccctaaatagcttccctattttttatcgtctggttcaataattcatgaatttatctaaactttttgtctgtttattatttaaacctgtgtcacacttggaatgaaaagtggggaactttgatctaaattgcaattactttttaaaaaaattctctaaagtctttcagaattttaggtgtccctctaatcttgtatttcagaagttgatactaattctttttttaattaccaatagctttgtgattttaaagtgctttaactttcctgtttgaaaaattactttttagtgtctcactacacagaatccatggccaccaatctcagcatcattaatatttctttttcctgaaactgttaaagccttatatttaaagttttgaaggggtatatattaatatggctgtgctagcatgatagctaaatattttcaagttgcaaaaaaaagtggaggcagcggtttgatagttagccagtcagaacatttaatcttgtccttgatcaaatataccctcttcggcatgttaaaactaagaactagtatcaacaaagaaaaaaacatttaaatttaaatacattttatgattttctgtcaagcctggattgttgagtgggaaatcttaaccattatatatttatattatgtttaaggctatagattccattcattttacatcactaaaatacaccgacatatacatatatgcaaaaaatatatcaatatatccaacatatacaaaaaacactgaaaacacaacaataggaaaaaaaaactagttaaaaagtgggcaaaatctggacacctcactaaagatacacgaagggcaaataagcagacgaaaagatgctcaatatcatagatcatcaaggaattgcaacatggatgcagccggaggccattatcctaagcaaattaacacaggaacagaaaaataactactgcatgttttcacttataactgggagctaaacactgggtacttagggacataaagatggcaacaactgacactggggactactggcggggagtagatgagggaagggttgaaaaaccattaggtactatgggcagtacctgggtgatgggagcaatcatacctcaaacctcagtatcacacaatatacccaggtaacagacctgcacatgaaccccctgaatctaaaataaaagttgaaattatttaaaaaggaattgcaaattaaaacaacaacaatgagatacctctatacaactattagcatgactaaactccaaaaaactgacagtgctgtatgctggcaaggatgcaaagcaaccaaaactctttcattactagtgggaacgcaaaatggtgcagtcacatgggaagacagtttggcagtttcttaaaaactaaacatgctatataatccagcagtcatgcccccaggtatttgcccaattgaattgaaaacttacgttcacacaaaaacctgaacatgactatttatagaagctttattcatatcatcaaaaaccagatgcaaccaacatatccaataggtaaatggataaacaaactatggtacacttatacattggaatattatttagcaataaaaaggtattgagctgtgaagccacaaaaagacaaggggaaccttaagtacatattgctaagtgaaagaaaccagtctgaaaaagccacatactgtatgattccagccatatgacattctggcaaaggcaaaactttagaggcggtaagatcagtggttgcaagggccttgaggagagcagaagaaggatgaaaagctgaatcacaggggatttttaaatcagtgaaactattctgcgtaatactgtaatagtggatagacgatatacatttgtcagaactcatagaactatacaaagcaaagcggggacgttagtataaattgatggtataaataaatattggctcatctattgtaataaatgtgccacattaatgcaagatatttataatggaggaactgtggggggaaatggagattgtttgtgggactctattatccgctcaatttttttttttttttttgagacggagtctcgctctgtcgcccaggctggagtgcagtggcgcgatctcggctcactaaaagctccgcctcccgggttcacgccattctcctgcctcagcctccccagcagctgggactacaggcgcccgcctccacgctcagctaattttttgtatttttagtagagacgaggtttcaccgtgttagccaggatggtctcgatcttctgacctcgtgatccgcccacctcagcctcccaaagtctgggattacaagcgtgagccaccgcgcccggccctttcttttattttaataaaataactacctaatttatgacagtaggaaagtaggatctggtgttctctgagcttctttgatttgtgggcaggtgtctgttgctgaattttaaaagttctcagccatcccttttttcttttcacattctgggtgaatgcagttttcatagaaggtgctagatttgtgcaaccctaaagataggtgactcctctgactcacagatccctgggagcctctcccgaacagagtttctttatccacacaccccacttcccacacccactcttccacataggtgttctggccaccagtaatctctgaaggatggaagatgaagagacatgacttttacctgagtctctactcctcccaagagaatgaatgttcctggaaacttaaccaacagaaaatcaggggatatcaatatatgtaagcactcattactcatgtaatggaggccttggcaaaatgtgacacgtaaatttctgctcagggagagtagaaaataggcacagagactagagagactggtaaagaatgaagcctcaaaggtgattgagttgtgttaaaggaacgtcttgatcaggctttgctttatttttctcttgtggagtatgaaactgggtgttacaattaaatatatttcttgatttcctaaaatgttataggctgtttccaatttttgttatttttggagtttcttaaatcgaaatttgattcaggataattaaaaaatataatgttaatgttaagatggaaggtaggtcaaaaggcaatcatgttaaacaagaggagaattggagataagaccttgaacacgaaagtattcttaaattcttgactattatgatacagtttgcataaacaactgagatttcttcagaaaactatagtgaaatgggacactacaaatcaaatataaatttaaaaatgaacacatttattcaatacatatccatagattattctggattaaatgtacacattttaagaataaagttttaaatttgaaaatgaaagactgtttcccatctaaacagaccgttggcttcaagatacttacaactgtgttaaatcatcttccattggttatagttgattatggcatgggcatccccaaatctggctgacccatactacgtttttcctaaatctcttttttcttctgtatcttgctaggctgctggttcatcctcccaatttcctgtatttaaaaccccagtgccatgtttgaccttgtcctttctcttctactgttcacatcttctgtctctcacattcattccaacctacacatcccagtggcctattcctatttaagcacccaaccccctctctcctgaatgaatgcagaaaactttctcatctctggactcatagcaccacagctatttttacacatgactgtcagatgtgtggagttcttgaaccatagttctgtggtgtcatcattcattttaaaaattttgattggctccctattacctagaaaataaactttagtatcctttgctcaacatgtgaggccctccacaatctaatttcacacactccaaaaccttatttctacctactctcttccaaggaccctgaaccccacattccaggcaaatccagtcattgaacacttacataggccatcagaagtcactgcaaaaccaatccggtctgactcctatgttgtttagtgctctatcccctttgtctgaaatggctttccctccacctctatttttatttactggcaccttccacagctttcaacattcagtttgtcatgaaggcagctgttatagactggactagaagactgtgaactgaattggtggtttccaaatcagtatcacacttgattcccacctccagaaattttgatagagggggcctggagtagagccaatgagtcttacacacacacacagacacacacacacacacacaccccaaaacaaacacacacttaccctaatgactatctaggtgccagccctagcctagaccaggctggtggaacatgctggattaaaaacaacaggacactgagaaagtatttgctacacagacatatgggatttgaccatgtgttatttacagataacctaactcattggagtaaaacctatcttaaattggcatatggtataggatatgttgtagcattttattagtgaacatttgtaaggttttatttgtgaaagctaataagactgcatttgtgaccatcacaaggaaaacagataaaactgtatttgtgaccatctcaaggaaggtgtgtcctatgccatgctcacctgccaagctggctgcagtcccttcctctcctgacttcactttgcccctaaaggtatctctgttattatactcatggctttccattttctaatactgtgtactgatcatttcaacacatgccttattctctaaacagactgaaagattcattaagtatctgaaaagcaaatgctgatgaacttgcctaaaataaaaagcatgaaccatgcaagtttctaacatagattgtagcagccaccccacatgactgcaatcgcctccccattgatctcccggctgacacattctatgtatttgtaactcagcaaccagagtgatcctttaaaaattatcagagagcaccactcctcttagtaaagcactaccccaccccagtcacgtagctttctgattcacaggagtaaaagccaaagtccttataatggcctaaaaatcgtacataatctgttccttttcagatttcattcactaccatcttcccccttctctctctgttccagttacaacagcttgccccctcaaacacaactagtatgttcctgccccagggcctttgcacctgctttttcctcttagagcaacaagtttgctccagatatctgaaaagctgactatctcgccaccttcagatgtgtgttctaatgtctctttatcaatgagagcttctttgtccaccctgggcatcttcttgcccttccttgctttattcttccccatggcacttactcacattggacactaaacacttgtttccttagctaggcattcttctcctaccctcacaacagtaggaatgtcctaaggttttgagaagactcccgtgctaggtttccagactcctgtcctctcacatttggtgctcatgcacctcttggtcattagtgcactccagaggttaggacctagagtacgtggctgtccttcagaggagggaaagggattgcttgggagcagagaagggagctttggcctcgcagtgcaggacccctgtgcccacaggcctctgtgtgttgacagcaatgctcttggtgtccacctgcactgccctctggtgttcagtcaaaatcaagcaaatggttacgaactgctataggggattgttaccaggtcctgagtctgtgttggaaacacaaacccagaagcaaacaaatctgcccaacacccctgacacgtgggtttcacagaaaatactgaggtcagagtagcatgttaaatgacaccacagtgacaacacaatcataaaaatctacactgtggactctgtcctagtttctttaatgaattgcatggaaaaaaaaagatggaaggggaagaataagaatgaagaatgctttagagactctgcaatccatcgtaatatccgtacaaggattctgcttttttaaaaaaagaaaaatggtgtgaaaaaatatgtaagactggccaggcagcgtggctcacacctgtaatcccaacactttgggaggccgaggtgggtgggtcacttgaggtcaggagatcaatcctggccaagcctgaccaacatgccaatatggtgaaaccccgtctctactaaaaatacaaaaagttaaccaggcatggtggtgggcacctgtaatcccagctaattggaagctgaggcagaagaatcgcttgagcccaggaggtgggggttgcagtgagccgagatcttgccactgcactccagcctgggtgacagggcgagactctatctcaaaaaaaaaaaaaaaagtaagacaatcagggaaattggaacagcgactggattttggttaaaagtaagtaattctggctaattttttagatgtattattttaaaaaggggatccttaccctttggaggtggatactaaaatattcatggatgaaatgataggatgccagaaatgctcttcaattaatctatgtcagggaagtgggatcagaggaatcaggactgtctaaaactgaagctgggtattaggtcaatgagttaattatactattcattcattatgctatttatttccttttgtatattctttaaatttttcataataatagtaataaagatatgttgaacatggtaaagatggaaaatgtacagagacagaagaaatattcttattttttatttcatacaattctatagtttcacattttgttttgttttactgtatttatgcattaattctataactgtaaaacatggtattaataattaaactgaccttatgaaaatttttggagagtgaaaactttgaaactcatgtgctaggtacatcattaaaatttatcattcaggtgacacctgatgactcacatctataatcccagtaatttgggagatgaagataggaggctcccttaagcccaggagtttgagaccagccctggctatatagtgagagcctgtttctacaaaaaaaaaaaattatttttaattagccaggcatggtggcactcacctgtagttccagctactcaggaggctaaggtcagaggatagcttgagcatgaaagttcaagactgtagtgagccatggtcatgccactgcactccagcctgggcaacagggtaaaaccatgtcttaataaacaaacaaataaatacataaatacataaataaataataaagtattccattcaacatttttaccttagtaatgctcaacatttggtttctacttatttccttttatgttgtattttctagaccaaattcacatatagtataaagcagaagaaactaatgattaaattcattgttcgtaattgtattcagtttcctattttcatcaacatttgtttacaaattttttttttcttttttgagacagagtctcgctctgtcacccaggctggagtgcactggcgggatagctcactgaaagctccgcctcccaggttcatgccattctcctgcctcagcctccggagtagctgggactacaggtgcccgccaccatgcctggataattttttgtatttttagtagagacggggtttcaccgtgttagccaggatggtctcaatctcctgacctcgtgatctgcccgcaccggcctcccaaagtgctgggattacaggtgtgagccactgccccggtctgtttagaaatatttttaaagaattattgcacttctgttcggatagaaaaacaaaaatacattttaagaatatatatttatatgtatgaaaatataaaattttgaaaagttgaatatttcaagccaattatgtagatgtccttgtccttccctgagctgctgactcacgttccacgaagcgggatgggtctcacagggcctgtcaggatgcaggctgtgatgtgaaggccactcgaatctcacaggattggacgggtttgtgaaggaatttggagcgagccttagttagctccttaacatttcctttgagcaacatcagtgcttttgacattttgcactgccgtataaaactgtaagtgtatgcagagatgtatgtttctgaataaatcacaaaattgacaagcaactgccatgcattgttttttgcatcatagctaactgataaagtacagactgcaacatttacttattcaaatacctttaaagatctggtatttttttgcttctacttcccaggaatttgacctcagggacattttctattatttccatatctattgaaatgaactcaaatcaaaaatgagaatgtttcattatacatttaaaatgtgagttttcccatttaaagtcacgcaaactgaggttactacgaaaaagatttaaaattgtgcagaatgaatcactgaaaaattagtttattctaaagatcatatattcagagtaaatatatttaaattttattcagtttcctctttgtcagcaaattagtgaataacattactgatatcttagatgtttgtggacacaaagagaatagaggtaaaaatcatgaccctcaaagagctcaaaatcctaagatttttatgggcagccccagaggtataaaattcaaaaggacattacttctccattcctgattaggtacgcaatgttctggattattcatggctcttggatacttgagagtaataatgacagtgacctctgaattaacatagttcaacttttataataattatgaccttcaaccatgtgaagtttgtggagcactgagatttcttggggcaattttgtaacagctaattcttaacagcaatgttatttcaggctttttggacattccctgttacaactgctgatcttttattcctataatggtacagaattctttgagaaaaataaattcatcttttcattcatttaagggaaaattgtcagcacgagcctatggctataatgttctccatcatttaaagaataaaaggaataatctggttgaaattgaattatctaaggttacatatggttttgattcaatggttaacgtgcatttttaacaagtgatatggtttggctgcaacatttacttattcaaatacctttaaagattttttttttttctgcctgtacttcccaggaatttgatgtcagatgcattttccattatttccatatctattgaaatgaactcaaataaaaaaatggggatgtttcattacacacttattaatgtgtaatttaagattaatgtgtaatcttgtaattcccataatcctcatgtgtcaagggcgggaccagatggacatgattgaatcatagaggtggttttctccatgctgttctcgtgatagtgagttctcacaagatctgatggttttataaggggcttcttccttcactcaaaactcattgtttctgctgccaccctgtgaagaggtgccttcggccatgattgtaagtttcctgaggcattccaagccatgtcaaactatgagttaattaaacttcttttctttataaattacccagtcttgagtagttcttcataacagcatgaaaacagactaatacagtaaattggtaccacagacatagggtgctgttataaggatacactaaaatgtggaagtgactttggaactgggcaacaggcagaggttggaatagtttggagggttcagaagaagacagtaaaggctgggtgtggtggctcatccctgtaatcccaggactttgggagaccgaggcaggtggatgacctgaggtcaggagtttgagaccagcctggccaacatggtgaaaccccatctctactaaaaatataaaattagctgggcatcgtggtgcatgcctgtaatcccagctacttgggaggctgaggaaggagaatggcttgaacatgggaggtggaggttgcagtgagcagagattgcaccactgcattccagcttgggcaacaagagcgaaactccatctcaaaaaaaaaaaaagaagacagaagaatgtgggaaagtgtggaacttcctagagacttggagggcttggaagacaagaagatgtgggaaagcttgggacttcctagagacttgaatggcttctaccaaaatgctgatagtgacatggaaaatgaagtccaggctgaggtggtctcagatggagatggggaacttgttgggaactcggataaagatgatttttgattctcctgcctcagccttctgagtagctgggactataggcacaggccaccacactcggctaatttttgtatttttaatagatacggagtttcaccatgttgtccaggatggtctcgatctcctgacctcgtgttccacctgcctcggcctaccaaagtgctgggattacaggcatgagccaccgcgcctggccaagtgaggcgttttaaacagcgcgtggttccaagtaatggctcagaaaagttagctattagaattgtaatggttgttagtgatgtttgccattttctttaagaatttcacacttgtatcaaaaaacagtattaaaaaaactatacaatcatttaatatataaaaaggataattctttgtagtttaagccataaaagttgcatccaaacatagatttaaataacctcttctccccacctttaatagtctttcaaaatatcgcatgtgctttttatattgtgaaaagaaataaattaaatagtcatacttacatgattaaaagttattttcatgtacttcgggaatttgttcatattagttacacttcaagttaatattacatgtaatattaaatgtacttaatattaaaagtgcatttaaaatacttgaatgaaaataaattttcataatcaaataaatcccagcactgattcaagaaaattataccaccatgctcatactaagaagacactgaatcaaagcagaaacacatgccttaatcgttgataagtgaagccttcagtgagtatcaaaaataaaagatagcaaaaacagaataattactacactaatcatagatgattggcaaaggtaaacataacaaatttctagtaaggagctgcttcaaagagtgatctttatgcgggaaaactccagcctggtgcctttgggatcactgatttcccttgctgggagtacttgcggtgaaactaataaaatcactgaggtgccacaagaaaaataacatgggaagaagctgaccaccgagttacagattcatgggaaagacatcaggaggtcatttccctcatttccttgccttgagattaatactcaagtcatcaacgctaaataaatatttcctgaaaataaagcatttctaggaaaaaaataactttgagaatcctcatgttggtataattgaatcaaggacagatgtgactaacttcagaagtctgttgttcttcctatattcagtccagcaaactctcagcaaagcccccagtgtatgaagaatatgaaaaaggagctctactagtagaatttgggactgagagtccagagttctgatcttttggcctgtgccttctaatgccctttcaccccacttcatctaaggcaaccctagaaattgtcaaagaaaaacagcagtgctggatacttgctaaaggcaatgagacctattgtattcagactatttcagcaggagggagagacttcagtataaactaagctcaactccaagtaagacaaaggaggctgatgtttttaaaaagagaacaaatgggaaataaaaagaaactatggaaaagtaaaaagaggggaattaaaaaagggactgaggactacgtgaaaatgcaaattataaaagggggtaagagcctggcacggtggctcacgcctgtagtcccagcactttgggaggcagaggcgggcagatcacgaggtcaggagatcgagaccatcctggctaacatggtgaaaccccgtttctactaaaaacacacaaaaagttggccgggcatggtggcgggcgcctgtagtcccggctactcaggaggctgaggcaggagaatggcgtgaacctgggagggggagcttgcagtgagctgagatcacaccactgcactccagcctgggggagagagggagactccttctcaaaaaaaaaaaaaaaaaaaaaaaagagcgggaggtaagtagagaattactgaaaatgatttgacatcatcggttacgacaatatacattatgtggtttggtagcattgtattttcttgagcaaagactcagcacagggcctggggttaactactccaagtggcagccaggctaatgtttggtcaagtctcttagcacagtgtttaggcaaatctttttggcttcagggaagttcacagtccctcctcttgttcaagagaaagaatgaatttctttctcatagaataaatatagttgttgcactccaaagtcctcaaaagaaaaaagttcagccattgtttatcaccgttgtgcaattcaggaagagtcaaggtggtaaatgcaagaatcgaggtttggcgtattatcaatggcggcacaattgtctcataagaatagagatgcacttggtgggtcatgcctgtaatcccaacactctgggaggctgaggagggcggatcacgaggtcaagagatcgagaccatcttggccaacatggtgaaaccttgtctgtactaaaaatacaaaaattagctgcgcatggtggcacgcgcctgtagtcccagctactcaggaggctgaggcaggagaatcgcttgaaccgggagggggaggttgcagtgagtagagatagtgccattgcactccagcctggtgacagagtgagactctatctgaaaaaaaaaaagaagaagaatagaggtgtacttaagagacaaagaatattgccattaaggatgtttttaagaagccaagtccaagatcaaaaaagacaaaggagagcattacataatggtgtaaagagttcaattcaacaagaagatctaactatcctaaatatatgtgcacccaatacaggagcacccagattcataaagcaagttcttagagacttacaaagagacatagagtctcacacaataacagtgggagatttcaacactccactaacagttattagatagatcaccaaggcagaaaattaaaaaacatattcaggacctgaactcagcattagatcaaatgtatctgattgacctctacagaactctccactcaaaaacaacagaatatacattcttctcatcaccacatggcacatactctaaaatcagccacataattggacataaaacaatgcttagcaaatgtaaaagaaccgaattcttaccaaacacactcttggacgacagtgcagtaaaaataaaagttgagactaagaaaatcactcaaaaccatacaattacatggaaattaaacaacatgtttctgaatgacttttgggtaaataatgaaattaaggcagatatcaagaagttctttgaaaataatgtgaacaaagatacaacataccagaatctctgggacacaggtaaggcaatgataagagggaaattcatagcactacctgcccacatcaaaaagttagaaaaatctcaaaaagttagaaagatctcaaattaacaacctaatatcaccactaaaagaattacagaagcaataacaaatcaaccccaaagctagcagaagacaagacataaccaaaattggagctgaatggaagaaaattaagacacaaaaataattcaaaagattgatgaatccaggattatttttttgaaaaaattagtaagataggccaacacctagactaataaagaaaaaaagagaaaaggtccaaataaacacaactaaaattttgagacccggtgtggtggctcatacctgtaatcccagtgctttgggagactgaagcgggtagatcacttgaggccaggagtttgagagcagcctgacaaacgtggtgaaaccctctctactaaaaatacaaaaattagctgggcatggtggcacacaactgtagttccaactactcaggaggccgaggcacaagaattgcttgaacccaggaggcagagcctgcagtgtgccaagatggtgccactgtacaccagcctggatgacaaagcaagactctgtctcaaaaaaaaaaaaaaagaaatgaaaggaatgctaacactgactgcacaaaaataaaaataatcaaataaccactaaaaactactctgaacacctctatgcacacaaactagaaaaccttgaaaacatggataaattcctggacacatatacccacccaagactaagccaggaagaaattgattgcctgaacagaccagtaacaagctccaaaattgaaccagtaacaaatagcctaccaaccaaaaaaagctcaggacctgatggattcatagctgaattctaccagatgtacaaagaactggtaccattcctagggaaagtacccccccaaaaattgagaaggagtgactcctctttagcacattctatgaggccaccatcatcctgatactaaaacctggcagagccacaatgaccaaaaagaaaacttcaggccaatatccttgatgaacatcatgcaaaaatcctcagcaaaatacttgcaaaccaaatccagcagcacatcaaaaagctaatccaccatgatcaaatagtcttcattcctgggatgcaaggttggttctacatatgcaaatcaataaatgtgattcatcacataaacagaactaaagacaaaaatcacatgattatctcaatcaatgcagaaaaaaagctctagataaaatttaacaccctttcatgttaaaaactctcaataaagtaggtgttgaaggaatatacctcaaaataataagagacatctatgacacatccacagccaatatcactttgaacgggcaaaagccggaagctttttgctcttgaaaactggcacaaaacaaggctgccctctctcaccactcctattcaaaatagttgtgaaagtcctagccagagcaatcatgaaagagaaagaagtaaagagcatctagataggaaaagaagtcaaactatctctgtttgcagatgacatgatgttatatccagaagcctcattccttcagcccaaaagctcctttagctgataaacaactttagcaaagtctcaggatacaaaatcaatgtacaaaaatcactagaattcctatacaccgacagcagccaaaacaagagccaaatcagaaaagcattcccactcacaatagccacaaaagggataaaatacctaggaatacagctaaccagggaggtgtagaattctctacaatgagaattacaaaacactgctcaaagacatcagagatgacacaaacaaatgaaaaaatatctcaggctcatggataggaagaatcaacataattaaaatggtcataatgcccaaagcaatttacagattcaatactattcatatcaaactaccaatgacattcttcacaaaactaggaaaactatattaaaattaatatagaaccaaaaaactaaggcctgaatagccaagacaatcctaagtaaagaggagaaaagctggaggcattatgttactcaacttcaaactatattacagggttacagtaacaaaaacaacatggtactggtacaaaaacaggcaaataaaccaacagaacagaatcaagagcccagaaataaggttgcacacctatgaccacctgatcttcaacaaagctgacaaaagcaagcaatggggaaacaattccctatttgataaatggtgctgggataactggctagccatatgcagaaaactgaagcatccactcttccttacaccacccttccttacaccagatacagaaatcaactcaaaaggattaaagacatagtgtaaaacccaaaactatgaaaacccatgaagacaaactaggcaatatcatcctggacataggaataggcaaagatctcatgacaaagatgctaaaagcaattgcaacgaaagcaaacaatgacaagggggatccaatttacttaagagcttctgcacaacaaaagaaaactatggacagagttaacagacaacctacagactgggagaaaatatttgcaaactatgcatccgacaaaggtgtgatattcagcatttataaggaacataaacaaatttcccagagaaaaacaaacaaccccattaacaagtgagcaaagaacatgaacagaaacttttcaaaggaagacacacatgcatccaacaagcatatgaaaaaaacttcaatatctatcactaatcattagagaaatgcacatcaaaaccatagtgacatactgtctcataccagtcagaaaggctattgttaaaaagtcaaaaaatagcagatgctggtgagaatgcagagaaaaaggaacacttagacacattggtgggatgtaaattagtttaaccattgtggaaagcaatatggtgattcctcaaagagctaaaagcagaactgctatttaactcagtaatcccagtactgggtatatacccagaggaatataaaccagtctaccataaagacacttgcacatgtaaatgttcatcgcagcaatattcacaatagcaaagacatggaatcagcctaaatgcccatcaatgacagattggataaagaaaatgtggtacatatacaccatggagtaccatgcagctgtaaaaaagaatgagattatgtcgtttgcaggaacatggctagagctggaggctattatcctcagcaactaacgcaggaacagaaaaccaaatactgcatgttcttacttgtaagtgaaggctaaatgatgagaacttattaacacaaagagggaaacagcagacactggggtctgcttgagcatgcagtgtgggaggtgggagaggagtggaaacagtaactgttgggtactgggcttaattcctgggtgattaaataacctgtacaacaagaccccatgacatgagtttacctttgtaacaaatcttcacatgtacccctgaccttacaataaaagttaaaagaaaaaaaaaaaagccaagtcccttaaaaagtctcctaagccatttggctggggaaaccattttctccttagagactaagcctgtctggaggggcgtgagctatgttggctgcttctcaggcacgtgctgccacgacttcttgattcatttctctttatcattcatgaatgaaaagcattgggaactcaccagtgcacaagcaccttcttgaaaactcagtatgtagtctaaggcgagctagttttgtaaagtcattttagaagctccaatacctcatggatttatgaaacaaaagcttatattaagtttgagatgaactctactaattattttttaaattattatttcaatagcttaaggggtacaaatagtttttggttatatgaataaattgtatagtggagaagtctgggcttttactgtatctgtcaccaaataatttacagtgtacccaagaggtgatttttttttatccctctcccttcctctctgagcctccaatgtccattatgcccctctgtataccttgtgtacccatagcttagctcccacttatatgtaagaacatgcagtatttggtttttccattcctgagttacttcacttatggtaatggcctccagttccaagttgctgcaaaagacatttgtgtgcgtgtgtggctaagtagtattcctttttgttgttgttgttgagatggagtctcgctctgttgcccagcctggagtgcagtggtgtgatctcagctcactgcgacctctacctcccgggttcaagcaattctctgcctcagcctcccgaggagctgggattacatgtgcccgccaccatgcccagctaatttttgtattttcagtagagatggggtttcaccatcttggccaggctggtcttgaactcctgacctcatgatccacctgcctcggcctccccaactgctgggattacaggcgtgagccacctggctgggcctgtagtattccattttttatatgtaccacattttccttatccactcctccgttgattggcactcagcttgattccgtatctctgctatcgtgaattgtgctgtgataaacatccatgtgcaagtgttctttatatataatgacttcttttccttgggtagataccagtagtgggattgctgattgaatagtagatctacatttagttccttgagaaatctccacatcgtttttcacagaggttgtactaattttcattcccaccaacagtgtatgagcattctctttcaccacatctgtgccaacatctgtttttgtttgtttgtttgtttgtgttttaaccttttggctagggtaagataattctgactagatggtatctcactgtgattttaatttgaatttccatgatgattagtgatgttgagcatttgttcatatatttgttggccgtttccatatcttcttttgagaaatatctgttcatgtcatttgcccactttttagtaggattatgtgttttttttcttgctaatttgttggagttccttttagattatggatactagtccttcgtcagatgtatcttacagcataggagttggctgacctggtgacaaagggtagaatatcaagaacagagcaccctgtaagtttggcctgagcaagtggctctccccggacctgtttaaggctgtttgtcatccagccattatccattcacaagtttcaggctcagcaattgtaggagcactcatgtttctaatttttccattgggaaatttttcatacatttccatttgagggacagcataagccacatcgcagcagccagcccaatgggctggaagtactttgtatggttttatgaccacatactaaataatgtcccttgagggcatactagtgttggttattgcctctagtggttgtaacagaggctagaggagctaacctggaatagactccaaagagacagttacaaacatcatcttctaaatggctgggtactttggtaccatttagccagcaattttttgcccagtctttcagttcaccaaaatattgatccggggtaaaataatttcctatgatactggtattgcgtgggtattgcagacaatgctgtccttaatgggagtttggctcttacaaagaatgtctgtttcttgaaaataggtttcatcttttcacaaggacacagagcatttactgtgttccacagggtgactatatttattagactgatttctagtaaaacaccacgtttcttaggttaaagaggccacatcatactcccagtcacaagggcttttaagaaataacccaatatctttctaaaagggagacctaaatggctgtatatttgtaatgttttctgccaaggccatctaaagcataagggagacaattattaagggaatacgagttttaggatagagtgggaatgggcatagacccggcaattactttggttaatttcattggctactttgtcagctaagagaccgagggaattacggtcatgagaggaaagcacgggatagggtaagataaggaggaaacagaggggaatcatgacagggctgctgaggctggagatggagtatatatgttgtaagtaggacacatcactaggataaagatgggacgttgtagaggacacaggagtagtagcagaatgcgtagacccaaaattgaagtcagagacaaagaaggggaatcggagtgaatcttgtttcaggatctttggcagaagcggactgcttcatcatatcatttacttgctccgtagttcttaggatggatgtctgtctccagctcttggctacttttagaggttcttttcttttctttcctttccttttctttttttttttttttttttttttgagaccgagtcttgctctgtcacccaggctgaagtgcagtggtgcaatctctgctcgctgcaaagtttggaggttcttttttttttttttcttttctttttgagattgagtcttgctctgttcccaaggctggagtgcagtggctcaatctcggctcactgcaagctctgcctcccgggttcacgccattctcctgcctcagcctcccgagtagctgggactacaggagcccgccaattagcgcccggctaatttttttgtatttttagtagagacggggtttcacctgatggtctctatctgctgacctcgtgatccgcccgcctcggcctccgaaagtgctgggattacaggcgtgagccaccgcgcctggcctggaggttgttcatagagtctcagcgtgagtctctggttagagtgccttccaattgaaatagattttgtattttttcaactaaaagacatgcacccaagttcaaacactctgtaatttgttagcagtgttagcaatgagtgaaacaataaaaggtcccctccctctgggttcaaggttagttttctgatgttggtgttttttcaaaatgccagatcacttacttatgaagcaagtaaggactgatcagggagtttaaagatacaagaagcctcaattgtggagtatagtggggctgtgtgtatttaattaatccctgacaatatctgaggttgttgaactgagttagtttggaatcttcggctagtttgcattagtaggttattctcatgggtatcccgtaatgattcaaagaggatcgtttgtgtgaaggtagggccaaggatctgagagtcagtgtgatgggtaatatctgtggccatggcaagttctttcttcagacagtttagccagttcagcttgaggatgctgttggctctttgtatagaactttatcactgaggatggtaagtccagtggaatatttggctggtgtgtgtaacctttcctatttcctgaataattttgccagtgaaatgtgatcctctgtcactagaggcagtagaggggataacccatgtggggaagattcactcttaataaaccttggcaaccgatgtccttgaggagtttcaacagggaaagcctcccattctattttccagtgaaggaagcctattttccagtgaaggaaggatgtagagggagccacttcccttttttgccccacctttatgctttttggaggattatgttgttggtagatgcagcaaatggcaacagcttggtccaaataaaatctaaagagtccaagccatattgttttgtttaatatatactacatgttatcctttctgtggtaaatctggatgagcaaattgtacacaatgacttgggagacagacttaggagttatcaaatggccatctgggtatttctgaagtccacttaagtgggtcaaacattcacctttttctcatccaattctttctgactctgaaattgttatctgggctgtgtgaattttacatttcctttagaggcattgtaaagacattgcttctgtcaatttatttaaagagggtaaataatcctagcaggactgtgggtatttgaaatgaagcccaggtatctagtcacaaggtttggagacttcctggatttcttaggcggccaaggaagaggatgctagcttagcacctttatcagccaatttatttccctgagcctcatctgagtattttatactatatccctcagctttaactgtaacaactagctggggcaatagcaatgactctagaagttctgctatttggggtttacttttgactggggacaagttgctgtcatgaatcctctctgttttcaaaacataccaaaatcatgcactacaccaaagacccagtgtctgtcactgtaggtgctaatcttaattccctctgccttatataagcctgaatgagaacagttaatttagccactttggctgatttaacgtgtggcaaagcttggcattcaagagttttgtgtagatgagtgatggcatatccaggctggaaggtcccaacctccttccagaagtaggagcgattgacatagagcatcaggtcgacttaggagagaagggtttctgacatatctaacctaaatgagacagtgatctggtttcagtagcaccattgtgtgtgtgtgctgaggggttcccttagtggacaaaatgtacagggtagcaagggatttttggcagcaaaggattgtgattgggtggggaggcatagtaatatttcatgagaagtaagtcgagaagcaaacgagtgctgtgtgttttcattaagtaatagggtcaacacagcatgggaacatacacatcaagtgggcggcctaacactaaatcagaagtagcctggatgagttggaagtcatggccactgtttgtaggccaggaggatatgcttcagcactggctggttttgtgggaaaacagagagaaagacatggctgagtctcatggtgctcagagaaggccacagccttggggtgccgtggtgaccacaaacacttcccccatcccataccaatctttaagagccttttccttcttaaagacctgtcacttagcaaagagctttcaatgaaccctcccctctgggccacttgttggattgcagccaatcagtgatggagggctggacacaactgtgggatgctgtgatttggtttagcccttgggtctagagtgctctggggtccactgtacttctgggataaaacgccaaggccacgactctcttgctcatttacaaacaaaaaattgagggctagctaaacaaggacagagtggaagcagctttctgtaagacacacccaccagtgtgccctgtcagtttaccattgccatggcaacactcaggcattaccacccctttcagcagcaatgacctgatgacccaaaagttaccacccttttcctagcaatttctgcacaaaccacccctgaatctacatgtaattaaaagtaggtatacatatgacagcaaaactgggctcagctgctactctcggcaccctgcctatggggcaaccctgggagcagtcactgagctgtgaccctgcaggagctgtaacagtgctgctttgataaaggtgttttcttccaccttaccactggctcgcccttgaatcctttcctgggtgaagccaagaacccttgcaggctaagcaccactttggggttcgcctaccttgcatcagcatcaggttttttttttaaacttgtaaaatagtttttgtgactctgtcatgtattttgcagtcatgaactaatattttttccctcaattgtcagttgcagtttcctcaaagatcattataaatactccttaacctacaaagtttggcagtcacagcctactctttgaggaacagcctgactcaccatcaagtggctcctcaggtggttttacttcccatgtttcccatgtgaggtactaagcctcagtgattcctggcaaaacttgtattctctgttagtattgcgctaactttggagtgagtttcttttggtgagtaataattttagtcaatgatactactgattattttatctttttttaggcttatgatgaatacctgatttatgattagtatgtttttcacttttacacatttcaaggaaggaaacaagaacagacagaaacacaacatacttcatgaaaccacattttagcatcctggccgagtattcatcactcagcaagatagagagacataaactatttctagcaagaatacttcataaatgatgaatagaagaaaaatagaagtcctaaaaatcttgcagaactgtcttaatttactaatatatttacactgtatcctaagtcactctctagcttcttgctctaagcatatgaaatgtaagagctaatgggaaccccagtgcctgtataaataacaagaaccagcatgtctttatttatggcagggaatactctacaacctgggacagatgccactctgcttcagtttggggaagctcctcactttaccatcctgacgttgaataaatgattcaaaggcaacctgatgcaacctgagccactggatggcttctgtaaataaagttatctcacctggcattcattacagagaaaacaagaaataaggcactacatgtcatatttgtctagatcctatacatatttaggttcacattaaaatgaagagaaaacaacataggctgagaatcagaaaacctgaactctgtcccagctcagctactgaccaaagagaattaatgaatcgctttaaatgtcagtttcttcattaagcatcgtagagaatgtcaaaaccaagtttacaaatactgtcattccaaaaccacacaactcaaatataaataatctttataaggtaacaaaaatgtacataatactttacataaacatttttagaataactttattataactcgataagcaaaataatccaaacctttatacatttctacaaggatagtcatgtatgtcaatttttgggtttcctctcgtgcctattttgtctcctgagccagcccctttccagctgacacatgtgctccgtgttctcccacaatagcctgatctggcctgagtccacgcccctgtgagcctcctttctttgcttacaacagcagcctgcctgatgtcagttatggactattctttttttcagcctcgtttcagggtcccctgcctcttagagctgctgctgtagcttagctagagacccgctgctgttgcatcatggaaaagtgccacatatgtgcacatgtgaaagaatacgcagaccttcatgttgtgttttagttttagaaaaagtcagaagtagcttcacttgatttcagcttgtaaagacataggagggaggcaactgggaatcaccgttgcaaaaagcaaacatcaaaaatcacattaaaatgctgaagtgttgtggagcacaaacctagctttattggatcaagcatttgtgagagttcttctacttgctttgttatgctttctatcagacagggctcattctctgtctttttttttaacatattcatttttttcctttggtctgtttagattattatcacatcttatgttttaaaactagcaaaatattatgtgtaagtcatgaagacagtgtaagaaataataaaatgaacactgatgtacacattacctgcctaagaataaaaaactacccgtatttttagagtccttaacactgtcctgttaatgagtcccatttcttatctttataattttgccaaaataaatgcattagtaaaggacattgagcattattgtttcacatatttttcagtttaaacaaatggaatcacactgaatatatttttctgaaattgctttttggttcaatatttaatttgtaaaattcattcttatgatatgtttgtctgtactttctgtgcattgatttagagtattccatcacaggataatactataatgagcattccattttattagattggggttatccatttttttctattacaaaactagatgtccttttcttgtatgagtctcctggacataaaaggtagattttctctaaggtaaaaacccaacattcaaataattgtgtcaaaagatttgtatactgttggttttactacgttaaaatgaactgttttccaatttatgctcccatgagaagttaaaggttctggtagatctatattctcaacaatacttaatagtatcaaacgttttaacgttagtcaacttggtttctcatttgaattgtaatctgcattttttagaagtactgaatcaaggtaagaatcaagtaatgaaaaactattattttagtaaataaaaatgctgtaaagacaataaagcaaatgaatgtaatcaaaagtggagacgggctacttcattctgatagtcaaagatggccttgctggtcatctgagttgagaggtggctagtaagacgagaagagatgttaagtagctgtggaaggggcctgctggcacagggcatgctccaaagccctgaaaagaggcaaacattctttccctctaaatacctgaactaagtaaaaacagtcctggctttgcacatttgaatatgcacaggtttaattaacatagtttagttaaatagcactagtctcccaacaacctggttacaatttcggttaccaccatatgctaactgtgagcaactgcataaaatccaaacttcattcccagctcttaattccacaaatgcctgtgtgagtaaataacagacaagcatcatgatcagggactgtattaatcttgtggggatgctgcaacaaagtacaaaaaaccgggttgcttaaaacaacagaaatgtattgactcgtagttgtggaggctagaagtcaaaaagcaatgtgttggtaggttcatgctctctgctggctctaggggagaatccttcttcccctctccttcctgtttgggtttgccagccatccttggtgttgtttgacctacagatatgtcactgcattttctcagtgtgtcttcacatcgtcttttgtgtgtgtgtgtctggagctgtatccaaattctccttcactataagacaccagttagtctattggattaggacccaccctaatgacctcattttaacttgagaacctctgtaaatgtgctatttccaaataagctgatattatttggagatattggggattaggatttcaaacatatcttttttggggaacacaattcacttccttcaaagcctgccagtgactgatcaatgtgcatcagctagttcgcacacagacagcaaagtctgcaatcgtgttgattccttgtctcccagtgagaaacccatgtgacatttataaatatgaataatcagaagaaaaaacttgtcaacaaccattgatgtgcagcaaagaaataaaaaatgtgataaccctggaagtggattcaaatacaatgtaaatggaatcatagaattggctcaccacaggaaacgcggcaagaggaactcggcgcaacgcagtgttctgacataaatgaggaacgcagctgtgattaaaaggatgaagaagccccagaggaagtgatgccggcaaagacagcaacaaacttcatattaaaggaactcttgtagatattgcatgacgttgacaatgttagatgctgttccaaaaacagcacgacagttcaccaaggcatagaaacactgctggctccttatcataagctatacgacaagagggaggcaagcacttttcaaactgggcttgatacacgtctataaataaataaagcactttaattggctgttgtttaatgttttaaattacagtgtataaactaagtactggccaggcgtgatggctcactcctgtaatcccagcactttgcaaggccaaggtggacagatcatgaggtcaggagatcaagacgatcctgggtaacacggtgaaaccccacctttactaaaaatacaaaaaatcagccaggcgtagtgtcacgtgcctatagtcccagccacttgggacgctgaggcaggagaatagcttgaacccaggaggtggaggttgcagtgagctgagatcacgccactgcattccagcctgggcgacagagcaagattccatctcaaaaaaaaaaaagtactaacttcactatgtttcatttccttatacatttataaccaacagtaagagatttttaatgttttggccaaaatttttaaatgacacagaacagtcgatgtttcacatggattgtttaggtcactttacagatcttcagcttgcatagtgatttgtatggccctgcactgctgtgcaaagagaggactgtttgtgttcttaaccagtaagaaggagggcaagaaagaggttctcagccagatattgcatatgtaataaaatgatgggagagggaataacactttagatatgaaatgtaccatgtggggaagctatttgaacaacaacaaaatagcttaatttaacccgatggagtacactcagccaccttctagatgtccctgcttattcttcaaatcttctcttttgtggccccaaagaatgattcactctctggagtgaaaaataaccgttgctttctttgcctggaactttaaactgacttgtgctgtatcatccaaacctactcaatcctctcttctccattaatcagtgaggtccaaaggagccaaagacaaatctctcctgtttttcttagaaatgtaaagatgttgcatctgtaaccacaggctgcttttaatcctaaaagtcagcgtgataatgaaatccagtgattaatttctgtcttctaatcaataagtagacatatcaatttatagtatgttagaaagcctcaacttcactgaaacaaaaagcaagaggctctgcaaatgttggagtgtgctaaaggaaaagcatggactgatgtttggggaaaggttggtcaatgtgatgaggccatctgtgtttgctaatagtgcttatcaaaattaggttcctacgcagagacagagaccaggagacaatcctgtatccttcttgatccttatagtccaaagggatggctcccaagtctttcagaaagacatttccatgttgtaggagatttaaaggggcagagaaagggtttataactgcaggttatctgtctttttttttttttttttccagacagaatctcactctgagcacaatctcggctcactgcaacctccgcctcccaggttcaagagattctcctgcctcagcttgctgagtagctgggattgcgtgtgtgtgccatgacgcccagctaatttttctctttttagtagagacagggtttcaccatgttggccaaaatgttctcgatctcttgacctcgtgatctgccctcctcggcctccaaaagtgctgggataacaggtgtgagccaccacgcctggccattgcaggttttctaaagttaaacctcttagaaatgggaggtcagggacctatagtcaagttttgggtgggacaaacagtaaattcttttggcagaattgaatgttcccaggcaggtgctttagaggggtatggggcatcgtagggacgtggctcggagctgatagacactgtgttggaatttggccaagtctcttagtgtatgtatgaggaggagggatgtgcagaagaagttgtctgtgccaagaatttatggttttcacaggttaagacagtggtgcctgggatcatctgcaaggcatgagtcaaatgttgacacaatgattgtttgcagactcatctgagggcttaggcagatctggacctgttgatactgaagtttctgaaggtagaggaagaaaacataatgtctcaataatatctgaagtaggggtaggaaaacagagatttaaggaggtgagatcccttaaggcctcagaaagaagcttcacttcttgcgcctcccttcagagtaaatgggtcattaaattagtttttgtaaccaacctgggaatgatggtgaagaagggaataatgagaggaaaaactttaaataagaatgcctgagagataatactaggtcagtgggagagaaagaaatttccaagaagttgtcatgggaaagggctcacgaataataaataaaaaattagttattaataatataaattaatatatgaaaaataaataagacatctgccaacagccacacttacagcactagatggattttaactgaattaaaacttgagtttttaatgaattttctacaatccaaaatttatttgtttaatttttgtaacaaaacaccatttctttactttttgcaaaagtaaaagtaaagtgctatttgtactttttaaataaaaactaattttaaagaaaaaaataattagctggacgtggtggcaggagcctgtaatcccagctactggggaggctgaggcaggagaattgcggaggttgcagtgagcccagatggccccacttcatccagcctgggtgacagagtgagactctgtctcaagcttcttcagtactcacatgtaaacttctactttccccttcagattacagcaaccatcatgccaaagctatacactctcagggaatccctgtggatttcactgatgaccacttgaccaactattataaaaatcaaggccaggggttctcaaactctcaacatttgtgtgctcatctccccttcacccagagactccccagggctgctgggccacgctttgtttggtttgactggaacatagctcaaaagggatggaaatttccaagaggtgttaagagacacataaatatttcaaagattaaaatgaaagaaataaagaaatgggcatttgtgagctttggtcatgagaatgcaggcctcgcagtacttagctacttccaaacccctgtccaaagagaggaccaaacgctagtgaggcttccggcagcacaagggtgtcccgcggatgaccccagccctcttaaaatgactgcctgaaaaagctcacttgcaaagaaaatttactgtttgtttcaggcaaaacctggtgatgggcaggtagagccccgaatcccctcttagaaccttagaaagcttgcaattataaatttttctccacctttgaagtgtaaatctacattccagaattgtctcctcaaagacctgagagttctctctttgaaatgcaaacattcaggaagctaactcttgctcttgttgccagttcctgagggaggggaaaggcctagctttggcgagcaccttgctccagcttgcacctctgactcttttattgccatgaaaatcaacatgtagacttttttcaaacccaatgacagcccattacaatggaggccatagcaatggaggtctctacatgcaaaaaaaatggtgggacagtttcctgataacaggtcaactttattccaaggataagcatgtcatgaaattattggatggcagattatgcttatctatggtcttcctttttctccttggtctcatcccaataacttacagatcctttaaaggcaaaggccaaatattcagctaagttaggcatactttagatgccaatatcaattttagctatatgggagatcctacttaagatattgaggacgatcatgtgtgtacagggcaaaaaagatgggacaaagagataagaaggggatgggaaatcacaccctccctccgcaccacagaccatgacctggggcaggtcctgtaacaccaagcccacccaggccccatctaacagtatgccgcattctacatgacctcagagttctttcggaattccagctgaaaagctgaaaagcaatactatatagttgtggtttccagctggcccatgttagtatgtatggcttttcttcctcgccatgaaagcactatgggagaacgaagcccgatgctgggcatgctttgccaggtgggtgctgctgaatcacagacctcagcaactgtgttccgcctccacagaggccggagatgtttgtttccccagtgtgttcgtatatttcagccagtttcatgcactttgccctctcagtttgcttcactttctggctcagtgaacctgacctgcaagtctccctgcagtttccctcagcaagtgctcactgggcagccccaacatgtgagaaacggctgtagggtgcacagaggtgaactaaattactaaaaactattactttactaaaatgcttcctggattccaaaactcaccaactgggagaaaggtcagacacacacggagacaactcatctacacaaatgatcatcagtgatttaaagaaggtacagcagagcgagactccgtctcaaaaaaaaaagaaaaagaacgtacaggagatcatggaataagaacaagaagagattactttccagggctctcagaaagtttctaaaaagaggtgccattgaccctgaccttagcattgtgatggagacattacagagctggtaggaaggagaagaagaaggaacggctggaacacacttggggtgaaatgagcggcatttcagtgtgggagctgcagactcagttttggtggaagagttaagagccaggatcttgtcaggaataattctgtgtccaagtgcagaatcgtggtttgctccactactgccagtaactccatttctcaatcatgatggtgatgcttttttttttttttggctcccaatcccggagagtggccatactgaagtcatattacaacaattaacttttcaactattagatgattaatttttaccaagtagcaagaacagctgtttggcacgtagcagtgtggcatgagtatcttgtaaatgaattaaacaaaatatctctccaacacacacacagtcattcttgctgcatgtcagcctccacttctccctccattatttgatgctgtgaagctgaggcagccagcttgagcgaaagctttcagatctcactccaacaaagagctttgattgattcatttagtataaggtgttttatctggctagagaaatccaagctgagttttattaattactaagaaaagtatgcaatagattaatctttgatcaaaactatgtgtgaagtagaaacatattacacatatggagagcagttttatggaataaaaacaatctatgtgtggcataactgacattgtctttatatttttgggggggtgtgtgaggacggagtctcactctgtcgccaggctggagtgcagtggcacaatcttggctcactgcaatctccacctccttggttcaagcaattctcctgctgcagcctcctgagtagctgggattacaggtgcctgctgccatgcccagctaatttttgtatttttagtagagacggagtttcaccatgttgtcgaggatggtttcaatctcctgaattcatgatcctcctgcctcggcctctcaaactgctgggattacaggcgtgaaccaccttgcctggcctataaataatttttaaaacagatacagaatatatagatagcttaacaattataaaattgtatttatcaagtaggtcacgaggtaaacattttacgctatgcaaaagggagcaaacctctgaatttgtcatgcagggtcactagtggaactcacagcaacaggtctgataaagcagaggagggaaccgggcttccgtgtgctttagagagagtgaaacatgaggagtcacaggcagagaaaactgtttttcagaaagaaaagaaaggggacatgacagcccagcagtagggtgaagagggcctctccgtgggtgccgctggcttgagctgctgtaagtggctgtgccgggaacagaggatctgtataggagaatggggaagggagtgctggaaccgggggtgggcaggagcagcagtctggagaccagaatgacctagggtttcctctcatgctcccattcccagtgtttcacgtgtgtaaagtagcaagcatgcatatactgcttagaggcatctacacttaacatactacactcatatacaacacttgcatcgtacaaagtacacatagtaggtgtggcatgtaataagttaccctcctatattttcttctaaaagatttttaaatatttgcatctcaaatttaagtcctttgtccatttagatctggcctttgtgtgatagcgatccatttttgggatagagatccattctgatattttcccatatggataccaactgctcataccatggattatatagaccctttctgactgttctgtaatgttagccagggcatacatcaagatttcacacaagcatacactttcacaatagcaattcctgctgtggtaattataacttcacagtaaatctggtacgtgatagactcacataagctccacctcccaccttcacacactttagtcttctatgggattgtcttagttatactgggcccttttatcttccgtataagctttggaagcagtttagtgacaatggtactcttgtctttttcttgattttaaaaggagtgatttcgatatttttaatcacaaaacatgataggtgctgtaggttatttgttgactccttttatcaggttaaggaaattaccctttattcataggtggaaatatcatgaattatttaatttttgtaaaataattttataggccttttgagacaatcatataacttttgtctttaattcattgataaggagatgatttcagtagattttctaacattgaactaaatttgtattactaaccgagcttgttcatggtttttatactttgctaggtatacttcctagtattttgtttacaatatttgtctctgtgtgcatggatgaggtacacaatagcaaggttaccctagtctcaaatgaattgaagaatggcctcttttttctcccctcgcaaataattagtgtaacattggaactacttgtgacatcatctgggcatcctgttttctttgtagaattattaattatcaactcaattactttaatggtatgatttccatccagattttctaattatttgagtcaactttaataagttaaatgtatccaaaaatttgttaatctcacttatttacaaatgcatatatttaattgtcttattacttaatgaaatagatcataaatataaaagtgtgtgtgtacagcttaagaagaatataaaatgagcatatgtgtccttccttcaggttatgaaatagaatatttccagtatcttagaaactcccattgcccttctacaatgccactcactccttccacaagaggtaaccactatccctaacttcctgttaatcattccattgcttgtcattacagacttgtatattgtttagttttgcacatttgactttttaaataagtgaaactatgtattgtttcttatgatcagatatgcatacacacaaacatgtatatgtatgtatatatacacacatacacacattatttttaagagcagttcaaagttcacagcaaaactgagcagcaggtatagatttcccatatactccctgtcccccacacatgcatagcctcccccataataaacatcccccaccagagtggtgcatttgttacaattaaagaacctacatgatacatcttatagtttgcattaaggttcacacttgggcttggacaaatttacaatgacaagtattcactattaaaatatcatacacgtactttcactgccttaagcatcctctgtgctctggttattcatccctctcttcctcctaactcctgggaaccactgatttttttttctatttctatagtattaccttttccagaaggtcataaagttggaagtgacatacgtagcctttttagattggcttctttcattctgcaatatgcatgtaagcttccactgtgtcttttcatggcttgacagccatttattttatcattgaatggtattcagttgtctggatgtaatacagtttgtttaattattcacctactgaaggtaatcttgcttgtctccaaatttttgcaattataaataaaacgtccataaacatctgtgtgcaggtttctgtgtggacataagttttcaactcctttgggtatataccaagaaacaagattgcggggtcgtataataagagtagatttagttttctaagatgccacaaaactattctccattttgtatttccatcagcactgaatgagagttcctgttgcttcacatcctcatcagcatttggtgttgtcagagttctggatttttgccattctaatatgcatgcagtagtatctcattgcagtgctgtgtttgagaatgtgagtagctgcagttcattcactcttagtgctgcgaggtactctattattggaatatatgatcatttagttacctattccacaatctacccatattgagagataactggattgtttccaggtttttaaaattgtgaacattctcatatatccctaggtaaacaaatgcaagaatttttctggggcctgtaacaggctgactagattgcactaggttgtagtgaagccactgggtcatagggtacatgcatgatcagctgtatgagctaacatccgttttccaaatggctgtccttctacttgcatgggatgaatgcttccacggttctttatccttgccaatactacacctttcagaacttccaaaaaattttgtcaatatgtgtgaaagggtatctaattgttaattttcattttcatgattattattaggttgagcactttttcacatgcttatgggctatttatgctaacttcttgaggtgttatttttcacttattaatttataggagagctttatatattctggatactaaacctgtctaggtaacatgtgttgcaaatatctctgccaagttttgcatatttttttctcattgcggtatccaataaacagaagtcttaaatttttatgtgatcaagttagtttttactcttgccgtttgttcttcttccctatgtaaagataaaagagatgctccacagtttttttctaagaatgttgagaaggtatctttatccattaaaatatatttttaggtttggtctatgggattaagtttcaatttccttttttcccccttatggagaccagtggtcccagtgttgcttattgtaaaatttactatcttcacttaaccacaagaaaagctgtgttacaaaatatgtttccaagtatgtgtgaaaaatatatttatctttatgattctactcagattaattagctctcaggactgctgtgtccagagttgattccttctggtgggttcgtggtgttgctgacttgaagaatgaagccgccgaccttcacggtgagtgttaccgctcttaaagatggcaaggacccgaagagtgagcagtagcaaggtttattgggaagagctaaagaacaaagcttccacaacggggaagagcacccacgcaggttgctgctgctggggtgggggtgggggggtggccaggttttattcccttatttgtcacgtttctatcctatcagagtgcccttttttcaatcctccctgtgattgactacttttagaatcctgccgattgatgcgtttttacagagcttgctgattggtgtgttttacagagcgctgattggtgtgttttacagagcatggattggtgcgttttacagagcgctgattggtacatttcacagaactcgtgagacaggtaagttcctgattggtgcattttactatcctctggtaagacaggaaatttccccaagtccccactcgacccaggaagtctggctggcctcagctcttgctaccagaggctaatttccaccctggtatttctcaggcccatagatagtgtgaattcaaacccaaaccaatatggctattgttttgtatttagaaattatcatacgttttttatttttcatttttttgtctaccctattgggaccaagacaagcacatattttcactttcttatgggggtgggattttcctagcccaggcacttaacgtgcttctttttagaaatcctagatttatgcaggaggcattttagcctatattccttcctgcatgggcatcagtctctgtttcctgaattaggtgctcatgggtctgggccagtaggtcctgggagacaccgcagggcaaatgccagatgagacactcacacctctggattcagactttttttgctcttctagatatctgaaaatttgccttactttgactcagcccatgcattaaagcagatgcttttaaatattttatgatgcatgttttaggaaagggtctgtctgggtatttcttctttcgatttgcatttttcattcagttcttctttcacactatcctaagcattaatcaactcgccatttatgtcagtacaaaacttcactatcctgttcattatcaccatttcattttgttctgcataggccagactatttatctaaaaatgtttaaagaaatctaaggccttaaaggattctttctcaaggactctactgtttgtatttagagaaatgctcatttgttccactgttttactttcttcttgggtcacgctctttgatgactgcgatcttacagaggatgacaaaagagggcccaccctgagacagtaatacctgcttgcccctttggattttattagtgttatcaaaatattaataaaatgtcaaaaacaaattactatcattagaatgtgtgcctcacttaaaaatttctctctctaataagaagtttttgtttcctagttcctttggtaccctaatgtttaggtaaatattctctgaggaaaggatgtggaagtcatagcaaaatatatgctggacttgaatgaaaatatctgtttcataaaagttaagcaggcaaccaaaatttaccttttttaacctaaattatctaaacatgtatttacatttctgtttcattgaaagatatttgacattaaatgtccctgagacagattttggaatgccctctccttctaaaatatattttttatcttttgtggactaaacagttagttaaaaatgaacttaatgattgctaattactaagttatctaaacagttatttaaaaatgaacttaatgattgctacttagttatttataatgcatttcaaaattaactttatcatctaaaccttttaacacaaatgtattaaattatgaaacagggaattggctatttttgttcaaatgtttattctcatcaaacttaaaatatcactcagctatatgattaaaaatgaaggcttcagtcattaaattatttcccagttatttgcgatatttctccgtattaaaggaacaaacagtgcccttcgaatctgttgatagttctattgatagtggccatcacaagttacacattatcaataaggtcaaggcacaaataaaatttctcccttgcttttcactcaaaaactacaagtatagttctttgataagatgtcccaatcatgatttgtgatgccaatcatagaaggaaagaggatgttgagaaacaataaaatagctactttaaaatgttctgtgcctgaacattttgatggcaatattggtcatattataaatttgaaaatataaattttaatctagattgactttattctactagtgattttaagagctttatccaagagaaacacttacatttttattcctaatgtttctttaaaaatgtgaaactcttttttttttttataattttaagaattcctagataagcagaacatagagccaactgttatgttctggttgtttttaataggtatatttatgttatcccccaaattataatttattaatgtctaacttcagttagatgagttgattacttttcatacaccattgactaaaggaaacctaattttacacgtaattcaaggggatctgtgagtaagaacatttttaaattaaagcaacacatgtgcatggaaaatcattcaaacagtttgatggcaaaaaaatcagtggaaaccagaaactttttttttccttccacagaccttggtcctgtttttcagagttaggcaggttttatcatactcttttttttactatatgctattctcttgaactgtaaataatattatataatcacctaatttgttttatcagttttaagtaatatcccttgactttttatgaacgatagagaatatagctcatttaccctactttcttttcttttttcttttttcttttttttttttttttgagacggagtctcactccctcacccaggctggagtgcagtggcgctatctcggctcactgcaagctccacctcccgggttcacgccattctcctccgtcagcctcctgagtagctgggactacaggcgccagccaccacgcccggctaattttttgtatttttagtagagacagggtttcaccgtgttagccaggatggtcttggtctcctgacctcgtgatccgcccgccttggcctcccaaagtgctgggattacaggcgtgagccactgcacctagcccatttaccccactttcttcttctaaaactatatttccaatttagtctttaatatataattttaagggatttttaaaaatttgcttcctctaaataatatacttacagtgcttaattctttgcttaaataatatattgtttaaatatacagtccatccaatttgaacaccactgattggctcagtaggatgtggagattagtgtacaacttccctcctctccaacagtccctgtcatagctttcgacttgtatcaaatatggttctatacttatattttcacattctatgtaaattacatcctattttgtaattataataaagtctgtgctttgttcataggttaattttgatcatggaatctcaagtgaattgacagcatcattattatgttttctttttttttcaaaccacagtcgcaggtggcatgatttgatttgtgtgaaggcaatgaaatgatacacagatacaccgaagcctcccaaaagaatcctggttccaagattcaagaagatggattaatgtttttccattaattgttggaatttatgccatttttttactatgtgccatcaattttaaagcacttctgaaaagagataacaatctacaatagctggcattttaaattcataaaaatatagtattttcttctatttttatacatttatgatgcattatttcttatttcccaggaattttactacctttgttttgaatgattaaaaaggaaacatagcaccttttttcaacacatcaccaagatagcctagttaatattcttctctttctgaagtagttgaattgggatagacagcttgccaggcctgctgccacttgtcagcatcgcatccctacattcaaccacacttgcatctaacgaccgtctctttcattaaatttcttttgcaccttttcttcctgaatgagtgcatgatagttaattttcctgtgcacttgcatgtctcaagaaggttttaattctttttgtattgcattaatatttaagttaagtttataattgcaaaatgatttatactcacaacattgaagactcctttgttttgttacatcctgtcaaaatgatgagaagacagatcatcctttagggaaaaattggttttgattggcgtcagcctttccaacagcaatgctggagacaagaataaaatgaagtaatatttttcaaggattaaaaggaaacaatttttaatccttgaattatttgcagccaaaatcttttaaatatgaaagcacagaaaaagacattataaagtaaggcctcaaaagttttatttcaaataaatccctttgaaaatgcctagaggacatactccactaagaagagaaatacaccgtggtgttagaattgagggttccagaatcaatggtagtggtgtttatcataccctaaaaaatacatgaaaacataacatattgaaaacaactccgagtaaacttcagaaagtaccaccttagacaaagtgctgtcgtaacagagaaagcaaaccagaggtggcaagaggaggctagagtacttatttggtttgctgagatgatattaattttgacacatggaggaaattgagaaaattaacataagtaatgacataaccaccattactatgttaaaaatttccagatttcaaacaaatgaaaaatttttgatctatagagtgagaggtacaaataggaaaaaagacacagtaaagtatgaaaaatcataaatgagatgacagaaagaagtcataatggaacaataattacataaatcaaaggttaagattgtcaggtaaaatttttaagtgtcaaaaaacacaatataacctatcgaaaataaattagtggaaaaaatgtagcaggaaaatatgaataaaaagagctaggtccaatttttgataaaaatttgaattcaagttgataatatcctaaagaaggaaaagtctgtaggccaatagaagaaatagcagatgcagaggtgtgctcacaaacatgagtgctcatgacactagtcatacaaactcaaattcccattacagttgtatacaaacatgatggccgacaagaaggaagttcctttaagcccacttggagcattaagacaaatttaccatgtgaatccctaattgaactctgagttacttctgtgaaggaatgaagaatgatatcataaatgaatttcatatagcactcaaagctcctcctctatatggttcaggatagacttgagtatccacggttctggagtgcaagggaggagaaaggaaaggtgcattcagacaaaaaaaaaagtgtacagaacacaccacggatatcagaagaggctgctcatggcaaggcgtggtggctcgtacctgtaatcccagcactatgggaggccgaggtgggtggatcacctgagctcaggagttcaggaccagcctgggcagcaagggaaaccccatctctgccaaaaatacaacaaaattagctaggcatagtggcacatggctgtggttcccattacttgggaggctgaggtgagaggattgcttgagcctgggaggcagaggttgcagtgagcccagatcgtgcctctgcactccagcctgggcaacaaagtgagaccccgtctcaaaacagaacaaaacaaaacaaaaaaagaggctgatcaagaccagactcagctcctaggccttgaactccagtcccaccttacaccctaaggttcctaaagaatcagtaacttagttcaccctaccccactcctggcttctagatgtagcacaagtttctaaacatgcaaacaatgagaactatctattttgacaaaataagaagaaatggagtcaaggcaacatataacatatttttgccagttctattgattaacagaaaaattgtatatagttaaggtgtgcagtgtgttattttgatatacatatacattgtgaagtgatgattaccacaatcaagctaacatattcatcacctcacctggttacctttttatttgtgtttgtgtggtggagaacacttgagatctactctttcagcaaatttcaagtatacattattattgactttagtcactatgctgtacattagatctccagaacttattcatcttataactgaaagtttgtactttctgacaaacattttttcttttcccccaactcccaggccctggtaagcactattttactctgttaccatgagtttgacattttcttagtatgcatataagtgaaatcatgcaggatatttgtgtgtgtgtgttcctggcttattttacttaccataataaactccaggtttgtccattttgttacaaatggcagtatttcctcatttttaaaggctaaatgatattccttgtgtgtgtgtgtgtgtgtgtgtgtgtgtgtgtgtaatacatttaaaacatccatctgtcaatggacacaggtagtttccatatcttggctgtgtacataacactgcaatgaacatgtaagtatacatatctctttgagatagtgattttctttactttggatatatacctagatggggattgctggattatatgggagttccatttttaattttttgaggaaagtccatactgttgtctctaatggctgtaccaatttacattcccatcaactatcaactaagcacaagggtttctttttctcaatatcctcagcaacatttgttacctttttactgttacaatagccatcctaatagatgtgaggtgatatctcattgtgcattttcctgatgattagtaatggcaaacatctttttcttagtatatacctattgtcaatcgtatgtcttttagaaatgtatctcttcaggtctgatacgctttggctgtgtccccacccaaatctcatgttgaattgtagctcccataattcccacgtgttatcagagggacccagtaggagacaattgaatcatgggagcagttttccccatactgtttttgtggtagtaaataagcctcacaagatccgattgttttataagcgatttcctttttcacttggctttcattctgtcttgcctgctgctgtgtaatatgtgcctttagcctcccaccataagtaaggcctccccagccttatggaactgtgagtccattaaacctctttttctttataaattacacagtctttggtatgcctttatgagcagcatgaaaacagatgaatacagtaaattggtactggtaaagtggggtgctgctgtaaagttatccaaaaatgtggaaccaacttcggaactgggtaataggaagaggttggaacagtttggagggctcacagaaagacagaaaaacatgagaaaatttggaactccctagagacttgttgagtagctttgaacaaaatgctaataatgatatggacaatgaaattcaggctgaggttgtctgagatggagacgaggaacttgttgggaactggagtaaaggtaaatcttgctatgttttagcaaagagactggcagcattttgcccctgccctagagatttgtggaactttgaacttgagggagatgatttagggtagctggcagaagaaatttctaagcagcaaagcattcaagaggtgacttgggtgctgttaaaagcatgcagttttaaaaggaaacggcataaaactttggaaaatttgcagccaaacgacatgatagacaagaaaaaccaattttctgaggagaaattcaagccagctgcagaaatttgcataagcaacaaggagccaaatgttcatccccaagacaatggggaaaatatctccaggacatgtcagagatctttgtggcagtccctcccatcagaggccaggaggcctaaaaggaaaaaatcctgggttggattcaggggctccctgctgtgtgccactttgagacttgatgccctgcatcccagccactttagccatggctaaaaggggccaaggtacagcttggactttggcttcagagggcacaagccccaaaccttggcagtttcacatggtgttgagtctgtgggtgcacagaagtcaagaactgaggtttgggaacctctgcctagatttcagaggatgtatggaaacacctggatgtccaggcagaattttgttgtggggcgggtgggggggggtccctcatggaaaacctctgctaggacagtgcagaacggaaatgtggggttgaagcccctacacagtccccacttgggtactgcctgctggatctgtgagaagtaggccaccgtcctctggaccccagaatggtagatccaccaacagcttgaccatgcacacgggaaggccacagacaatgccagctcatgaaagcaaccaggaggggggatatgtcctgcaaagccacaggggtggagctgcccaaggccatgggagcccacctcttgcataagtgtgacctggatgcgagacgtggagtcaagggagtgcattttggcactttaagatttgactggcctgctggattttggatttggggcctgtagcctctttgttttggccaatttcaaccatttggaacaggtatatttacaccctccctgtacctccattgtatctggaaaataactgacttgcttttgactttatgttctcatagctggaagggacttgccttgtctcagataagactttggagagtggacttttgagttaatgctcaaatgagttaagatgttgggggactgttgggaaggcataatttgctttcaaatatgaagacatgagatttgggaggagccagggcagaatgatatgatttggctgtgtccctacccaaatctcatcttgaattgtagttcccataattcccacatgttgtgggagggacctggtggaagacaattgaatcatgggggcagtttctcccatactgttctcatggtagtaaataaatctcacaagatctgattgctttataaggggtttccccttttgcttggctttcatcctgccttgccggctgtcatgtaagacatgcctttcaccttccaactgtgatcatgaggcctccccacctgtgttgaactgtgagtccattaaacctcttttttctttataaatcacccagtctcaggtatgtctttatcagcagcatgaaaacagactaatacaaggtcctttggaatcgtctaagttcctaatttatttggatattaacttcttatcagatatatagcatgtaaatattttctcccattctttaggttgtcttttcattgtattgattgtctcctttgttgtgctgaatcttttactttgatttagtcccatttgtctagttttgcttttgttgtctatacttttggtgtcaaatctgaaaatttattaccaataccagtgtcaaggagcttttctcctatatttatgtctaagagttttacaatattgctcctaggttgaggtcttttatccattttgagtcaatttttgtatgtggggtgagataagggttcagtttcattcttctgcatgtggatatccagttttcccaacaccatttattaaagagactaaacttttatcattgtgttttcttggcaccaatgctgaagatcaattgattgtaaaggcatggatttgtttctgtgctctctattcttttcccttggcctacatgtctgtttttatgccagtaccatactattttaattactatagctttataatttagtttggaataaggtaatgtgaagcttccacttttgttttttctgttcaagaatgttttgactgtttggggtctgttgcacacagattttagaattgcttttttccattgctttgaaaaatgccactgaaattttgataggggttgcattatatctgtagatcacactgagtaatagagattcttttatcttcaaattctttcatcagtgttctatagtttttggtatatagaaattttactttcttatttaaatttattcctaagttaattttttgatgctattgtaaatgagattgtgttctttcagatggactctcgctctgtcacccaggctggagtgcagtggtgtgatctcagctcactgcaagctctgcctcccgggttcacaccattctcctgcctcagcctcccgagtacaggcggccaccaccacgcccggctaattttttgtatttttagtagagatggggtttcaccatgttagccaggatggtctcgatctcctaacctcattatccacctgcctcagcctcccaaattgctgggattacaggcgtgagccaccgcgcacagcccgagattgttttcttaatttctttctgggatagttcactgttagtatatagaaatgcaataggtttttttttttttaatgttaattatgtgttctgtaaatttgctgaatttgtttcttaattttaacagtttttttttggagcctttagaattttctctatataagatcatgtcatcttgaaatagacacactttcacttcttttccaatttggatgccttttatttctttttcttacctaattgctctggctaggacttacagactttttcagaaaccccccacagtaatctaggggagtccactgtcactagatctgctttataagaaaccctaaagggagttcctcaaactgaaatgcaataagactaattagtatcatgaaaccatatgcagttataaaaagtcactggtaactatacagtcaaattcaaaatactcctaatactgtaatgatgcagtataatcactttaacttttaaaaggttaaaagacaaaaaatactacaaataaatataattacaaaatatacaaagaaagaaactctgacatcaaaaaacataagtggaggggagtaaagtgtagggtttttgtatatgattgaagttaagttgttatcaacttaaaatagaccattataactacaatcatgcatttcttaatgcggatatgttctgaataatgcaattttgtcatggtgtgaatatcatagagtatacttacacaaaattagataataccacctaacacacacccaggctatatggtataacctattgtttccaggctacaaatctgtacagcattgtactatactgaatgctataggcaactgtaatacaatcataagcatttgtgtatctaatgtatgtaaacatatgaaaggtacaataaaaatgttataaccttatgggaccaccgttgtatatgtggcccatcattgaccaaaacatccttgtgtggcacacgatagcatacaatgttttatgtaagcctcatgataatcacaaagacaaacatgtaacagatacacaaatgagaattttaccacgtttaaaaaagaattaatacaaaggcacaggaaagaatcaaagtataccactacagaaaataatcaaagtaatcaaatcatgcacagcaagagagaaataaaagaacaagaaaactacaaaatgcctatcaatagttactttaaatatcagtggaccaaatcagtgaaacaaaagacacagagtggctgaatggatagtaaaacaagaaccaaatatatgccacctataagagactcacttcacctttagagacacacatagactgaaagagagggaacaaaagaagagaaagagtagctattcttacaacaaacaaaatagactttaagtcaaaaactgtaacaagagacaaagaaagtcattatagaatgatacaaggctcaattcatcaagaggatataactactgcaaatatatattctcccaacattggagcacctaattatataaagcaaatattaacaaatctgaagagagaagtagacaacaataatacaataacagtaagggacttccatatcccactttcaacaatggattgatcattcagacagataatcaataaggaaacagctgacttgaactacactatagatcaaatggaccagacatatacatgacattcctttccaaaacagcaaaatacacattcttctcgagcatacacagtacattctccaacataggtcatatattaggccagaaaacaagtcttagcaaatttaagaagattgagatctcaccaagtattctttttgactacagtggcatgaaactgaaattaaaaacaggagaaaacttagaaaagtgacaaatatgtggaaatcaaccaacacactcctgaataaccagtagatcaaagaaaacatcaaaaaagaaataaaatatcttgagacaaactaaaatgaaagcacgacatactaaaactgatgagatgaagcaaaagccgttctaagagagggaagtttatacagataagtgctaaataaagaaaaaagatcccaaataaacctcaaaaaatagaaaaaaataatcaagcccaaaattagaaggaaataacaaagatcatagcagaaataaatgaaatagactagaaaaacaatagaaaagatgaatgaaacgaagagttgattttttgaaaagataataaaaattgaccaacctctcactaggccaagaaaaaagaaatctcaagtaaataaaattagaacaaaaaaggagatattaaaattggtaccatagaaatacaaaggataataatagtctactctaaacaactatgtgtcaacaaattgtttaacttagaatagagaaatttctagaaacatacatccactagactgaaacatgaagaaatagaaaataaaaacagataaataatgattaaaaatattgagtcagtagtcaaaaagctcctgaaaaaggaaaatccaagaccagatagcttagtggagaattctaccaaatgtttgaagaagaattaatacgatttcttcacaaactcttccaaaagttgaagaggagggaacacttccaaacattttttatgaggccagcattaccctgataacaaagacagaaaaggacactacaaggatgacagagatttttaaggtacaaatgatgtattgttggaattgaaaatacaggctttgttagtacaaagatttgtgtgtggataggtggatgtgtactggtgtgtgcatgcatacatatacaagcttaacttgttttattgcacttcactttattatgcttctcggatattgcagtttgtacaggttgaaggtttgtggcaaccctgcaccaagcaagtctaccagtgccacttttctggtagcatgtgcttattttgcacctctgtgttacatctttgtaattcttgcaatatttcaaatgttttgttattattatatctgttatggtgatctgttatcagtgatcattgatattactattgtcattgttttggggcatcacaagccatgctccaaaagacaatgagcttaattgatacatatgtgtattcgaatggttccatcgatctgcccttcctccatctcaccctctcctcaggtctgttttctgagacacagcaatattgaaattaggccaattaataactctataaaggcctctatgtgttcaagtgaaagtaagagtcacacatctcttattataaatctaaagtgagaaatgattaagctgagtgaggaaggtatgttaaaagccgagacaggccaaaaggcccaggctggtctcgaacgcctgacctcaagcaatccacctgccgcagccttccaggtagctgagattaaaggcatgagccaccatgtccagcttctatgcattattttaaatggagtattgaagactctgttactgtagaactatttctaacttcaattctgtcaatattttggtcacaggccttaatgtgattacacgctggtctgatgttcatggccaggacattttgttttcctgttggacataaacaatctcacagaatatcaacttcagaaggttaatctgagaccgtgataagtgcaaacaaaaacaagggcactttataatgttgtctaagtgcagataaaaaacaaggtcttgatgccacccacaaaatacttaataatcatattgctcctgctttctgacagcatccaatctaaagtcttcactttctgagatcctgtccgaaatcaaccaattaaagtccaaatcgtataatagtttctctctaactcctcccactgagatgacccatagtaccccattccttgctgcaatgtaattatatttacttacaagtgtgctcctggtggtctttaactgaagggcactgactgggtcactggtgaagttccccgcaggaactgagtcagaccccatctcagggccctgcacaagataggtgcctgctctaaggcgtggaccctcgccacagccctggcccgtcttgacgggcgagggttactgtacttgtcccaaccgtacagatgagaaagctgagactcagggcgagcaacccgggtcccagcggagcgcccggcacacgccgacacttcagcaccagtcgcggtggccaccactgtgcgcggagatggctgcgacgcgtgcgcaggtaaagtccatccgtgccttgcctcccaccggcgccttccccggcctctggtttttgtacccgccagcggctccgactccatcgcgtcctcttccagtctagtgcttttttccagatctcgatcccaaactccctcctgccagaatctggacccgaatccacccattgcccgttttctgctgccgctggagagaatctctgaggtccccaggagagcctgcctgcacggaagagatgcctcctcagtatggccgcccccggagaggagcgattaagtgcagacctccatgttgctcttgagcctgagcggcttcagggagccatgtttgttactggcgggcgccgacctcactgagcatgtgcagccctggccgggcggcctcaaagttctgacatcacagggcggttcctgaagtggacgtagttgtaagagctagttattttagacaatgcctctgggatcagggactctaatctggaaataggtagtaggagaggtcggtgatgcagtctctggatcagagacctgagctatatggggttagagaggggccctgggcaggcgagtctctggggagtgtggtgagaatccttgtgtaagatgctgggaggaggtggggtcagggctggggtccgtgggccgacgggttgggggatggccagcgtcagggatcagtagtagagattctatgtgccctgatcgccagtggaggttttaaatacagagtattcatgagtttagcaatgttattcgcctctcattatttaaataatttgaaattttccccaataactagtgtcttagaagtcatgaaaatttcagaaaatgacaggtctcctgagttcgtgatgggagttgggcagcagtcgcatacgagcacctggagagtccttgccagttctttggggatggggagctcttaagactgccctgagaccgccctttgacctcattatggtcctttctagatcaaatgctgttttccatgactgtctctgttcttcccatacgcgaatggcaggcatccagatctccaagaatagaggattaggagagactccaccacctatgtcctcacagttaattatcgatttgtgtcagttgcccattttctcacttcctgtttgtgtgtcaaggagtattaataaatctttgcctatttaaagatattagccttggattttcaaatattgcatattttgacatgtaaaaatttgttagttttattttttcaaccgatctgacctgtatagttgggcttgaggaagcttcctcattctacatgttactatggattttctaatattaacacagggttgtattttttccatataactttctattgaatttctttttccatatgataggtggtgaaggtttagcccagtaaagcagagaggttaagaggttagattgggggctctggagccagacctatgtagatctgagtcctggctctggcacttgaaagccgtgtgaccttggttaagatacttagtccctctctgccaaatggagaaataagggcacctaccccatagggtagttgtgtgattacacaagttaatacacttcaatcagtagcaagaaagtgaatgtcaagctgtatttgttcaggcagccatatggtagccccacgtccttagtaaactgaggtattgaagtatcttctttttctttcagaaaatatttgtcaagcaccttctgtgttctaagaactgttctagagctttgcatgctatggaggtctagaaattcacattatggtggcaggtgacagacaatacaaagagataaagcaatttcatatagtgataagctagggaggagtgctaaaaggagccaaggtgtagtggtgactggaaggtgaccagggaaaccactgtagggtttctaagtgatgagatctgtgacaaatccctgtggtcagcagcaggcattggatatgtaactttattctgtcccattgatcttgtagtcaaccctggtctgttctgtattgttttaattacataatctttgtaataatctttaatacctggtggagtgctctgtttacttatttctgcataattaaccacccctaagcttaacttactcatggttctgcagggtgactgctctccatgtttctaggtggttctgcatggggcctctcacatgtgctacagtcaaacattagccggggccacagtcatctgaaactcacttacatggctgacaattgatgttggctgttgcctggagaagacatatgtggcgtggtggaatggaatggtgactagattcaagaaagagcttcccaggaggaaggctaccaagagaccgaagtagaggcttcagtttcttaaaaaaaaaaaaaaaaaaaaaaaatcgggcaaggcacgatggctcatgcatgtaatcccagcactttgggaggccaaggcaggcagatcacaaggtcatgagatcgagaccatcctggccaacatagtgaaacccgtctccaataaaaaaaaaaaaaatacaaaaattagctgggcatggtggtgtgaaccggtagtcccaactactcgggaggctgagacaggagaatctctagaacctgggaggcggaggttgcggtgagctgagattgcaccactgcactcaagactggcaatagagggagactccatctcaaaaaaaaaaaaaaaaaaaatacaatagcagaattcccagaatggaatttatgtcacattctatggatcgagcaagttgcaaggcagccagattcaaggggaagggagctattcctcacctcttgagaagcaatgtgtgttgaggaagggaaagaattgatggtagctgtctttgacttctgccatacagagcaaggtctccacactcctttctcctgtaataattttccatttgaaaattttccttgcaattctcacacctttattatttcatataaattttacaatcaatttttttcttgtctagataaccatgccatttggattaaaattgcattacattgcaacttttgagaaactatgggaggagaattggcaaccttataatattgaatttgctcattaaggaacatagtttctctgtttatttaggtgttatatttttcataacatacatgttggtatttctacccaggcttttctctttgttttgtcatgtaacccatgaatgagactgcactgtctgtgtgattgggcagttgcccaaagtttaaggtgttaacatgcattaattcacttaatcactcctcatttcctccttccctcaacccctgacaaccatgaatctgccttctgtctctagatttgcctattctggacattttatatagatgtgtcatccaatatctggtcttttctgactggcttctttcacgtagcaggattctacggtttattgaggttcattcattgtgtggcctgtatcagtgcttcattcctgtttatggctgaataatgttccactgtatgtacatatgtatgtataccacactttgtatatccatttatttactggaggatatctgggttattgacagtatatttcaggagtccccaagatcatcctcccccttgatctactgctctttgtatcttatatgacctgtgcagaactatttatctggaaattaggtgatggttaactaaatatagttcttctaaagactcattttccgttggtattacatcctgaggagactttaactcactctcccaatacatttgatcatcaatatcagtattaccacatgacttatttgcatgaggtaatcaaatctaaccagccatgccagtgttacccatattgcatgttgtggtagtagatgcagccccccaaaataaaagtcaaaagatgctcgcacattcctgaggttcttctcagccactaacaattggtgtagttcatcatcacctggaatgaccaaaatgtctcccatggaaatgcggctcagctgtgtaggcttccatttaactttgtcaggttccgaggcagggctggcttgagtggtcttgtttccactttggctatgatgaataatgctgctgtgaacattcaggtatacgtttttgtgtggtttcatttcttttaagtatataccttggagtgtaattactggatcatatgataactctgttttaatttttgagaaactaccaaaatgttttccaaaacagacaagattttacattccctcagcattgaatgaaggttcttatccagtttcctgttcttgctgacactccttattgtttgtcttttgaatttagttatctcagtggggtgaagtggtgtatcattgtgttttgatttgcatttccctaataatgaatgttattgagcaccttgtcacatgcttattggccatttttcatctttttgaagaaatgtctattcatcttttgcccatttttaaattgcgttgtctttttattgagttgtaagagtggttatatcgtctggaacatgtgttccttatcagatataagacttataagtttttgtcccattctgtggttgtccttattttcttatgtaacctttgtattagtctgttttcatgctgctgataaagacatacctgagactggtcaatttacaaaagaaggaggtttattggactcacagttccatgtggctggggagaccacacaatcatggcgaaagatgaaaggcaaggaggagcaagtcacgtcttacatggatggcagcaggcaaagtgagagcttgtgcagggaaactctcatttttaaaaccatcagatctcgtgagactcattcactatcatgagaacagcacagagcaaaatgaatcaacagttgacaaattaaggattaacttatgcaagatttgactgagaatactgaagaaaacattctcgacatactcgacatcattagttattaaagaaatgcaaacgaaacgtataatgagctgcctcttcaaacctactagattcaacaaatatttattatttatttgctctatgccagaaatgtgtcttcatgccaggttaagaaaaagagaaaacagaaaaaaaaatagctgtccctgacaggaagagcttacgttctttctttttgggcgagaaaggcagtgaaaaattaaaaaaagaaacgcagtattaacatgcggataagttctagggtgaaatttgaatgcagatccagagtgactgtctgcctctcaaaagaattctgctgagatgtctagaattaagtagagtagcaagcaaatatctacagcgcatgtctctttcaaagacagaaaaacaaagtggtttttaaggtgggtgaatcttggcatttccaagaaatatcaggaggctcttaaggatagaatgaccaaaacaatgagggctgtgataaaataaattgggggaggtatggagaaggatcccatattgtttctttcacaaacaatgacaaggttttgggttttactttgagaaggggaacaattagaaagctatgagcaagactgtgaaattatttgatttatgttttataatcattctgactcctggctgaaaaacagcctctaggaatgaaagtgagagaaatagggtcatcatttatgaagctattccaatgatccagtgctttggcagttgcctggacatggctagtaagaggtaaaagtaatctgatacatcttaaaggcaggtgttcatggatttgatatggcaaatgaaagaaagaaaccactatgtgttatattccttgagccaaaattgaggtgtaaaataaacatgctcacataaatggttgattatgttcttaaatgaaggagaaaatagttgcagtgatgttaagtcatcaaccatttaaagtgttgcttttgaaagagatgaatcaaggaagggatggacatgaattttccttacctaaaaagctagtgaaaattaagattgacatgaacaggattaaaactttattttatagtggtactgagatgaaacatcacactatctgacttcatagcttaaaaatataatcaccccaccaacttctcactcttttcaaggattttgtgagtaaccagctttaatttggaaaacctagacttgtacatacagattgttatgtttgtgagtatgattatttctatcattttgttttacattgtgctttatcattcaataattaatatctatcattttccattaactaatttattttatgaccatttattattattattaccctatggtagtcaataattactgatacatattccattgttttttgggatttgatatagaatcagagaagtttgttgccaactcctttttagttgaatatatattgtttttgtcttatatttagtttttgtaaaacttcagattttccatcttgccccactatttattgctaaaaatcatatccaaatatgacaaggtttaggaacacacacagttaatgaacacatgttaaagtataataacacagaatacatttttgaaagtaagtttattaaaattagcaatatatttctagttatatgcataaggatataccaacatggattttgcctgcccaatattaattttctcttaatttcttacttacagaacttcaatttggtcaggagtctaagccccaaattatgtttgctgtcatgtactcatgacagctctttttcttgatttttctagcctttatccatttggaaatgtgaaccaccttttataggtgagatacagtatagctgaacacttctctaaaggtttctgtaaaaaagcataaatgtacaagcctatcatcccgattctatttagtttgccttgaatatgaatgtgataagtgaagtaagatctcacatcttgcaacatgaagtggaagaagggtcaacatagaagaaatgtcagaagaaatgaaccaatagaaaattcctcatttgctaaattttgttaaaagaaaaaaatagattttaatattaatctgatctacacaggcaaatgttaactgcaatgaaaatgtcttttagataattcagaacactttccatccttggtaaaagtattcattttactgactcactattatatattttgttaagttagaaactcatattcaatcaaaggaaataaaagttccccctaatttctaggaatataaaaaaataggtacacatagcttagataatattttctatatttgttcaagtaaatcagtttagtaattgtttgaaatacttccaattgatatgagtccaattttagaaggaattttagttggaagtgttattctctttatgaagatgtaaatggctctgtttactggccaatatttacatacacatacagtcaatgaatgttaatttgcacacagtggcatatataattcaaagttcattttattagttaatttagatatggttcaatgagagtttcaaactgagggcatagagtcatataacatactctagaagaacaactcacaaaaactaaaataaattgctttaccatgtttgcctttgtatttcactttttctgttctgaagaataagcatggtaaaatttacatatatctaatgcatataatgggcaatgtatgaattattttacaaattactcataaccagaagagttctgttggattttaccatatggccagattcatcttgcctttcaaacttatgtaagtaatttttccaaatctctttttttcccataacatacatgctgctgagtccactcctccaaactaagtaaacataggaatgctcatggccaaatcataagtatagaaagtgactttggaactgatgaagactttcttcttgtctacgctttagtcaggcttctaggaacactctttttgactctactttgtccttgggccctgtctttacactgcctagtccagctgttgcaagaatgctgctaagtcagtttagagagaatctcccactcttgatatctgatcactctggcttgccttcagcaagaatcctcttacgttagctaacaagaaatcccctacccttgatgtctcctcttagtaatttgtattcattgacaacctttcactctgctcattagctgcacttcccagatatctttgctgtgttcagagttgaaccttatctctcttgcctattagaatcatcttgacacctatcattttaatcttaaataaagtgatccttaaccattttaacaagtgttggaaatttttttatttagcagaactaacaaattgtttgcgaactattgaaatagaactattctattatggcctgcagatatttttctcaattataattcactttcatactgtaaaagtatctttgctttgtgtatatctttttcatataaaaacttttaatttggcagggaatagtggctcatgcctgtaatcccagaactttgggaggcccagatgagtggatcatgtaggtcaggaattgagaccagcctggccaacatggcaaaaccccatctctactaaaagtacaaaaattatccgggcatggttgtgggcacctgtattctcaggtacttgggagactgaggcagcagaatcgcttgaacccaggaagcagaggttgcagtgagccaagatcaggctgctgcactctagcctgagtgatagagtgagtgagactctgtctcaaaaaacaaaaaacaaaaaaacctttcgatttattttccagaggtctatttttaatttagtaacaagatttttaaaaatatttataaaattaaataacaatagaatgttagaactaggccctataaaatataaaattgtcaaaattgcttagcatgattgtagcttcaaggatcctattgttaatgtggcaacttctgaaaccaaacatcatcatgcttagcatcaagagctaaagtagtcatgagttaatggagaagaacaactaaggaattggctgccgaagtaaagtttatgctaaatttaaatgaaatgaaataacaaagtagtttgaaatgaacattccattgattatttttaaaattttatttattaacaaagtagcttatactaactgcccactgtctatcccaatagttacagcaataacatatagttaacatttgtaattaaatatttcatttcatacaaatagtattttaaaattcaagtgttgatttttaagcctttgaatgtttggctgtttaaaatttaagtgcatataaaaattgtagaaaagggtcattattaataaaatattcaaaatatggtaaattttgcatgatgatttaatatatgcaaattgacaagtgatgtgaatagtacatttgaatagagaaaatatgtacataaatgaatggtatttcagaatctaagcaaattgatgactacattatgtacttgtccccaatgtaaatgaaatattaattagaaaacttttttttttcactaaagggctgaacataaagtgtgatggcaaattggtgtgttcttgtatttcttgtctttggggattcttttcagtatattttcacttaatgttttagcaacatttttcgtcatccttttacacttatagctggactatgcttagtgatagaaaatagttatataatgggattatacttggccatatgaatttgatggtatgagttaatctgtgtttcaccttacttgtgtctacttgtaaatcattgatgctaatgttattagtaatttttagagggtagaaatgttttctatatgacatttttgagaaaaggaagtcaataaatcccatttgatatgcaacagaaataaagatctcttatttcaattttaaaatgctttataacttacattgctttgtttcatgcattatttgttttgatcagatgcaaaatgagtcagtaatgtcatctaaccacaagtttgatacattttttaaagaaaaatttccaaaatactttaactgagcaataggctaatacttcataaattaaaatatttaaatattcaatctttctgagtggatatttgttgcatatctgataacttggcctaattctgtaattgggatgagaactacccaattttattggtaacctcttttctgctctgcaactttggaaatactatggaggactccaaattcatttgagacaaaaatattaaaaatgtatcccctgattaggatttcagttccaaagctctccttggagggatatagagctggagaaaatcacatttatttttcgtctctttaatattgatatataaaagtcaggttaaaattagtatcaaattgggaagcctgcatggtaaaccggctggaataatacactctgcaatatgaaggaaaaaggaaaaatttagttgatttatttacctaactataattttttaaagaattttaagtttctaataaatttaactataaatttttaattttctatctttcatttagtaccatctatataaacttttccaggctacttctctgaatcacctggcaaaatcttataatttaccacctaattgaataaaacacacacacaaaataatctattttgaataataaacatcatttataattatcttgttgagattgagagtaatcatcaggtgtggaaaaactattgaggaaattttaacaatttaaaatgtaataatcttttttgtattatgtgtgttttatactcagaagtgcatatgttttataaaattatgtgaatttataaatgtggtcaatattaatattaaattgtatcttttaatagtatcttcaattatctttttttttgctgctggattccatttagaaaaaaaaaatgttctatatagcagtgttgctttctttttcttttctttttgcttttctttcttttttctattgataaagtatttacttgatcttggggaagaggtatataatcaagtgaccacatttttctttgttacatattattaaaaatttataatcaatctttccaaattgtaatcggtctgaaacccatttgctttactcaaattatttagtgactgtaaaagtttcagaaacatatgaaagttacaaattagctttaaatgtgtcatgtttaaagcagttgttttaaaagctaagtcattatccattattatgtaactagtattctaaatatcacatctttgcattgtttgacttttaaggcatatgaaatgttttggatcagagaaatcatttgcttcacatccctaagagacagactctatgggtactgagtcatgctaacagtggcaaaacctgacaaacaataagcatcattttcaaatattttaaacatttcacataaaaatttacttttagcatacattgcagccatcgaggaagcctaaagtaaggaaaacctcagtgaaatatgatgaagttaataaaaagaaatagccatcattttatttgtttaaattgccattatctctcatataattatgtacaatatataacataggataattaagtcaaactgtgtacctacagatatggagagccttatattttaggaaaaagtaaaatgtaaattaactggtaaagatgagcttttcaatctataaggcatagacacttttccttggtggatttgaaaaggttcttagaaatctgaaaataagatagtttttctataataaatggtaaaaaacactttcacatcttaaccttatcatagtatcacaatgctggaatgtttttactgggaaataagtaagctaattcaattataaattgcagtagaggaaaggatgaaggttaaaaaacactatctattcaaatccttagtcatgaggttgaattcattgaatcagagtgtgaatatatatctatatttgagacagaatttgtatgtatgtgtgtgagtgtgagtgtgtgtgtacagtcattagacatttgcctcatggacagtggaggaaaacatttgctgagctgctttcctaccttaaagatttacaactgcactgttttcaagatatactttttatatctcaaataatgtaatatattatgtttagttgttgatataacaagatatctgaataccccataattgaaattatacctggaaataaatacttgaaatacttgcttcagtgacatttgtggaagtatacttatttaagttcaaattataggtatattgaacaaaatgatattggattcttcactggctgcatacttctgaaacttgtaaataatttgaaattagtttccaagaacagaaagacaaatattagataggaaataccaaattcttaagattcatacatataaaagtgaaataaaaatcaaacttaatcttatcatgaattttctactgtggcttaattttagaacttgttataaaaatagaaatgctattaatttaattacatttattaaaatctaaaaataggtgattatagctaggacattgacaagtgtaactatacatgagtaaatataactgaggatagcaacacatgaaatatatcataaaattgaattattctataaatagtattaagtctgtattacttggaacttgattccacttagaatgtccctgcttttatttatttatttatttttgtaaacaaaatgagcaagaggttattacacttcattcactgcgaaaaggtaacactacatcaaagataactcacatacttgcagaaatatggaaggtagttctttcttttttttgttaagaaatagggtctcactatgttgcccaggttgtagtgcagtgactattcaaaggggtcatcccactactgataagcagaggagttttattctgctcaatttttgagttgaccactccttaggcaacctggtggtcctctgctccctggaagctaacatattgatgccaaacttagtgcagacacttcctcagcatagtgcatacaacccagaaatcctgggctcaagtgttcctcccgcctcagcatcctgagtagctgggacaacaggtgtgtgtcacctggctgaaaggtatttttaaatacaaatgttgtccaggagtgacagaagctggagaattggactacttgatggaggctttgtacaagctttgaacaataataacaacaaaattgaaatgccaaaaatattgtttagcagttaaccaccaataaaaggaagccagccatttcacacagaggattttgttaattgattgcgtgattcaaggaaataatattattaggtgtgtattagtccattattgcattgctataaagaaatacctgagattgggtaatttataaagaaaagaggtttaactgactcacagttctgcatgctgtacagaaagaatgttgcatctgctgggcatgtggggaggcctcatgaaatgtataaccatggtgggaaaatgaagagggagccggtgcttcatatagctgggagcaggaagaaaagtgagaggtgaggaggtgctacacccttttaacaaccagatttcataataactcactcactcactatcataagaatagcaccaaggaaatggtattaaaccattaaaaagaaaccactccacaatccaataacctcccatcaggccccacctccaacactgggtatttcaatttgacatgagatttggttggggacatagatccaaaccatattattttgccctagtccctcccaaattttgtctttctcagtttgcaaaatataatcatgccttcccatcagtccctcaaagtcttaactcacttcagcattaactcaaacatccaaagtctaaagtcttatctgagatgaggcaagccccttctgcctaagaccctgtaaaataaaaaaaaaaaacaaaaactcccaagatataatgtataatgggggtacagggattgggtaaatactcccatttcaaaagggagaaattggccaaaagtaaggggctacgggccgcatgcaagtctgaaacccagtaggaaagttattaagtcttaaagcttaacaatctcctttgacgccatccagggcataccactgcaaggggtgagctcccaaagccttgtgctgctccactcctgtgactttgcagggttcagctcctacagctgctctcaagggctggtgttgagtgcttgcaccatttccaggcacacggtacaagtgctggtggatctaccattctggggtctggaagatagtgtccctcttctcatagttcccctagatagtggtccagtagggacactgtgtggtggctccaaccccacctttcccctcttcagtgccctcgtagagattctccatcagggctctgaccctgcagcagatttctgactgtacatctaggtttcttcatacattctctgaaatctagcctcaactcttgtactctgtgcaccctcaggcttaatgccacatggaagccatcaagacttatggcttgaaccctctggagcagcatcctgagctgtacctgggccacttggagccatggctagagctgcaacagatgagatgcatgtagtagtgtcccattcttccttcgttgtcctctgagcctgtgatgggaggagctgccacaaaggtctctgaaatgccctggagggtatccctcattttcttggctatcagcatgtgccttccttttagttaagcaagtttctgcagcttgcttgaatttctctcctgaaaatgggctttttgttctaccacatggccaggctgcaaatttttcaagtttctacactctgcttcccttctaaatataagtttcagtttgaggtcatttctttgctcacacacatcaaaatagtttgtcagaagtagtgagcttacctcctgaatgctttgctgcttagaaattttttccaccagatacccaccagaacttgagatactctcaagttcaaaattccacagatccctagggcaggcccacagtgcagccaacctttttgctaatgcctaactaaagtgacctttgctccagttcccattaagttccttatctccatctgagacctcctcagcctggacttcattgtgagtctctatcagtagcttggtcacaacaatgtaacaagactctagtaagttcaaaacttgccctcatcttcctgtcttcttctgatctctccaaacccttccaatctctgcccactatccagtttcaaagccactttcacattttccggtatgtttacaacaatatcatattcctctaccaattttctatattagtcctttcttacattgctctaaagaaatacctgagactgggtaatttataaagaaaagcagtttaattggctcatggttctgcacgttatacagaaagcatgatgcatctgctgggcttctgcgggggcctcagtaagctaacaatcatggcagaaggtgaagggggagccagcacttcacatggctggaagcaggaagaagagtgagaggtggggaggtgctatacacttttaacaaccagactcacaataactcactcactgtcacaagaacagcaccaaggagatggtgctaaaccatttaagagaaaccgcccgatgatccaattgcctcccaacaggccccacctccaacagtgggacttacagtttgacatgagatttgggtggggacacagatccaaatgatatcaatgtgttaaaaggaaaaggagatagcagtgggaaatggatatttaacttcagtttatgagtttttattttagagttctaaaattatgtcttatactgcctatacaagtgctagaatagtttctgtattaagtggtagatattaatatccaaatatcatacttaccttctttgaccttgcagtttaagacggcattttaagaaagtaaacaaacacattgatttttttttaaaggagacatttttcagtaaaggatataagtatgttaacatgagagatatagaaaaattacagatggacagacaatcctacatagaaacctaaggaagcatttaactcagacacagagattgagaagagtaaagtgggtgaaatctgggaaagaatgcttccagtagaagaaacagaatattgaaggaacagagattgatgtcaagagttcagggaaacaaaccagaataagaatgtttagacaaaaggctgatggtagaaggatattgagactgaaagttatagagagcacaggcttactcgaaaattagtagacaaaagaacatctgtaagttcaatcatgaaggagtgccagaattaaagagaaaataaggaaataataaagggaatcttttgatgtgaggaaccaattgggctaccaactcagcctgccagcctgccattccagtgacagtaggaaataaatgttctgtaagttatttggaaattagaggacaaagtaattgtttgttctataggtagagaaacatttttgtaaatgataatacagctgttctaccgatttctcttaattttcaaaatttttgaaggggtacactatattttcatgatttgttcattctgatttccaactcatatttgttcatcattttctctttaaattttaaaaagttgaaagacattcatatcacaaaattttcacaggataatttttctagttgcaactgtagatttatgtggatatatacaaatctctctagtgacacatctaaagattaatgttatgttctgttccatagggagcaaatataccacatgaaacatcgcaactatgaatccaactagactgtatgggaaacatatattgaaaaataaattaaaattataagttctatgagaaaacacaaacatttgagtaaaaaaatgagaaaggtttagtggtgacttcttcccatgttagaaaaaaggattcataatgaacaactttttttttcatgtatttcctacaattgagtaaaataataggactaggtaagtttactggtttgcattttttcatctgggtctggttttccatttcaattgttagccattgtattaactactttcaccattcaaaggaatgaatgatctgccatagtattttctgcagttccatctcttgttttcagtatcattccaattctgcatctatctaattttgatctctgttctatttattttcctgattcataacattttgctttgtgctgagcacctaattgtctctctgtcattctcaacattttagccctatggtctaaaagatgcccaaaagaatgtagcatattctagtatatcagtgggacaacataaacaacttgcttaattgttaatctatttaaaaatgaaacagtgtttttcattttttcaatcaatttaatgctgactagatcctataactacattctactttttataactaaagaactccagaaaaataaatgtaatagctttgctggaaaagattaaccttacaatgccttcctaatgcccttactttttttttttttgaaaagtgttttctggtacacaaaaataatattctgaaatatctctctgatatttgattgccggatttaacctacatacctctgaaccttggtttttcagacatgcaaactgcttaacaagttccaatgcattaatcaatgcaccattgcataacttacagtaagaaaagttggtagatatttcagcaatgccataaaatatgcttccatttaacactttgagacaaccaatacactatttatattattgagacaaaacaaacctaagatcacagaaaaatatttattttaatagaatggtatttaagtagatagtttttttgttgtgtttttgtttgtttgtttgtttgtttgtttttgagatggagtctccctctgtcacccaggttggagttcagtggcccagtcttggctcactgtaacctccccttcccaagttcaagcagttctccctgcctcagcctcctgagtagctgaaattacaggcatgcaccaccacacctgtttaatttttgtgtttttagtaaagatgggatgtcactatgttggccaggctcgtcttgaaatcctgactcctgacctcaggtgatctgcccaccttggcctcccaaagtgtaagtagatagtctaaatgattatgggtttcaataggttttgttaatttgttttagttgacatacaagagcactacaaaaccacattattttattttaatttttatcagtaaacttcattatattaaaggccatattgcccactgaatatgattttgataagcacaacttctataatttacaacttactgtatatggtctaatataaattacatttagctatcttgaataaaagatatgaatccccaaaaacttaatatataaaataatttctacaatcaattaagccacatggggcctggtgtgcaagggctgcaaacagcatcatcctaggtagtgtacagcagcctgttccttgcgtacaacagcctttgccattggacatttatgtcttggatctagtgctttccctagtctaggtttaagaccggatgtagtatgcctttggaaagcctcaggacccagaggtcagagttcacattggccatgttcatccataccaagctgcaaaccctggagcatgtgactgaggccttatttagggccaaattcaagttcagtgaatgcccaaaaagccacatctcaaagaagtgcgattttactaagtttaatgcatatacattttaagacttggtggctgagaaacaactcatcctggatggctgtggggccaaatatagccctggaatcatgggcccctggacaagcagctagccctgcattagaaaagagctgccccctctttacgcatgcccaccagtgaattctatttcctgtacatctaataaatcaatctatctatctatctatctatctatctatctatctatctatctaaataattcaataatatgcagtagattaaaaaaataaacacaacttgatgtctaactactgtggatatattttgtcatttattaacattcccctttcaggttaatatcaagtcaacaaaaatttggagttctcttgaccctttccccaatgtgtaaattagtaatataatgtcaatattcagacaggcaaataaactaagctccctttgatgaaaacgacatgcagtaacgcttccctactgagaatcatcttagtttgtgaaatcataatctggaatggctatatctgcaaaatacattaaaagaaagaaaatatgaaaaacataatctacaatacttttatgtatatctaatcattttatatttcttttttattatactacttgaaatacatacataaaggataaagagtttcaacaaatctcaaaaaggaaacctaattatgtataatattctgactgattttgtttgcttaccaaattgaaattgaaaagaaaaaatacagcactctataaaaaaataaaatgatttcaaaatataattattttctccctttgaaaatataaatgtttaaataatggtgaaatagagaacataaacattcacaaatattacatatccattcaacattttcaggtattattttgttttgttcaaacctccccttctgtcatttttctctcctttctttatctttagcataactgagctgctttccaaacatctatagttataccggacatagcattttccaacatcaaacatggtttttcttaaacaccagttccaaatattaattcccagggaaaatgacattttccatatgtgagaaatattggaaccaatataacaaaactcattaacatttataacatttgaaaataatttcacaaaagttttatttaaaaaattttattgtaaatttatgtaagaaattctctatccattacatgacttgtataacatccacagtatactaagaaaatatttttaaaatataggataaggtgtctaaataataaatttttaagactgcttagagccactattaaaaatctgagaataaggcatgaattttttttttttttttttttttgagacggagtctcgctctgtcgcccaggctggggtgcagtggcgcgacctcagctcactgcaagctccgcctcccgggttcacgccattctcctgcctcagcctcccgagtagccgggaccacaggcgcccgccaccacgcccggctaattttttgtatttttagtagaggcggggtttcaccgcgttagccaggatggtctcgatctcctgacctcatgatccgcccgcctctgcctcccaaagtgctgggattacaggcgtgagccaccgcgcccggccgaatattttttgatctatagagattatatatcggcatgctggcattggcttttattacagaataagcattttaatcttcattcactctcatcaattcattatagaaaccagcttaaaaaaaaagaccaccacttgtagaaaacagttaatatttcgatggtttacctggaagtttactgggcataaatttataaaatacatttatggatggaaataaactgttttactaaacaatattacagaattctgaatagatgctgattaagcagcaaatcaacaaaactgtttatttaccagtttggtggctattatgctaattagatcatctgtttaaaatgtgtccatatggacaatttttctgtaaatgttttctttatctccacattgtgtggtagtattttcatagaaccaagtagaaattaacttaaaaattagttatttaaagatgacaatagaaggttttgaactttgagttccaaaaggcaagcaaatatttctgaaataaaatatattatatatatttaatttctaatttaatttacatataaaatatttttaaaattcatgtgaatttgagatattttcacattgattggactgtttttgtacctcattttgcttggtcacactaaagtgagattcatcatcttgtggcaccaaaggaaaactagtgtgattataaggaaattattacagttagacaactgtgcattaatttcatcattaaggaccaaacatgtatacagatataaatacttttctcaatacattacttgcaacatatgcacaattatgtaacaattatggtgaactaagtctcctagaaatttccaaaatattttttttgcctttttttaacctctaaatccatataaatcaagggaaaatattcttgcacatatgtatatttaaacatgaacctaaccaaaagtaagagaaatttgaaaaagtataacatatcaaaatgtggaaatttctgtgtttagggaaaaatctatcccattaagagcttgcattagaaaagaaaaattaccttgaaattatgatgaaagcttccaacttgttattataaaaatgagaacaaattaattctgaagcaatcagaaagaagaaaataataaaggttaatgaagaaataaacaacattaaatggagaaaaattatatagctaagtaaattaaactaaatttagatctttgaagggatcaataaaattgttaaatctctggccagactatggagaaaataataggaaataaataatttacaaattttaagaatgacagaagtggctggggttggtggctcatgcctgtgatcccagcactttgggaggccgaggcaggcggatcgtttgaggtcaggagttccagaccagcctggccaacatagtgaagccctgtctctactaaaaatacaaaaattagctgagcgtgatggcgcatgcctgtattcccagctactcgggaggctgaggcacaagaattgcttgaagctgggaggtggaatttgcagtgagtagagatgaggccactgcactcaagcccgggcgacagaacgggactctgtctcaaaacaaataaacaacaaaaaaagaatgatagaagtaacatttccattgtcctacaacagtttaaggataactaaatgaataccatgatgaaatttataaatgtaaattagttaatttagattaagtgtataaatccctcaaaagatacaaactaaggcaaactcaaaaagaaagcaataaaatgcacatccctatatatctgttttaaatttattaatacccacctagataaacgaactgacaaattttactaatatttaaggagatataatttatacattacacaaaagtttaagaaataaaaaagaggaaacacttttctttttttttttaataagaggttgctttgtacttttttttttattatactttaagttttagggtacatgtgcacattgtgcaggttagttacatatgtatacatgtgccatgctggtgcgctgcacccactaactcgtcatctagaattaggtttatctcccaatgctatccctccccactccccccaccccacaacagtccccagagtgtgatattccccttcctgtgtccatgtgatctcattgttcaattcccacctatgagtgagaatatgcggtgtttggttttttgttcttgcgatagtttactgagaatgatgatttctaatttcatccatgttcctacaaaggacatgaactcatcattttttatggctgcatagtattccatggtgtatatgtgtcacattttcttaatccagtctatcattgttggacatttgggttggttccaagtctttgctattgtgaataatgccgcaataaacatacatgtgcatgtgtctttatagcagcatgatttatagtcctttgggtatatacccagtaatgggatggctgggtcaaatggcatttccagttctagatccctgaggaatcgccacactgacttccacaatggttgaactagtttacagtcccaccaacagtgtaaaagtgttcctatttctccacatcctctccagcacctgttgtttcctgactttttaatgatcgccattctaactggtgtgagatggtatctcattgtggttttgatttgcatttctctgatggccagtgatgatgagcatttggtacaaggaggaactggtaccattccttctgaaactattccaatcaatagaaaaagagggaatcctccctaactctttttatgaggccagcatcattctgataccaaagctgggcagagacccaacaaaaaaagagaattttagaccaatatccttgatgaacattgatgcaaaaatcctcaataaaatactggcaaaacgaatccagcagcacatcagaaagcttattcaccatgatcaagtgggcttcatccctgggatgcaaggctggttcaatatacacaaagcaataaatgtaatccagcatataaacagagccaaagacaaaaaccacatgattatctcaatagatgcagaaaaagcctttgacaaaattcaacaacccttcatgctaaaaactctcaataaattaggtattgatgggacgtatttcaaaataataagaggaaacacttttcaacatgttttatgagtctaccgttatccccataccaaaaccataaaacagacattacaagaaaatgtcctgtagacaaatatgtattttgatgatgaatttagatttcaaaaacttcagcaaaatattatccaattaaatcctctcatgtctgtgtgtgtgtgtgtgtgcatgcacgtgtgtttgtaaaatatatcattactaattggcgtttatcttgggagttcaagatggtttccatattcaatcaacccatcaatgtggactatggtcacttgaaaagaccagcaaatcctctgcacaaaaggccactagaaattcattaaagcagccttccatcattctcgaaattgaccaaagcattcaactacctgagaaatatttatgtttggaaagctattgaaatgcaattaaaaatatcaggaaacctgtttttaccttttgtcctaatcttgctaaatccttcttaattttaggagacactgcttctccttccactgttcttttactttctccttcccctttgtttttgcctcccccttcctctcccttttctacattccttctctctcctaaatgctgtataaatttctacatatgtaatcatattatttacaaataggaacagttttacttatttctttccagtctgcatttattttattcttcctttttttccttacacactggatagaactctaagtattatgttgaaaaagagtgataaaagcaaacatctttgctttattcctgagcatacatgtggaaaacattcagtgtttcacagctaaatatgatggattttttgtatgctctttatcaagatgaaggaattttctgctatttctggtttgctgaatttttatcacaagtaactgttgaatagtgtctttttcccctgcatttattgaactgatcatgcattctcctattttagaatattaatatgatgaactatattattagattttttaaaatattgcaactgtcttgcatttctggaataaacatggcttggtcatgtgtcacttttttacatagtgtcgtattcaagttgtcgaggattttgcatctagggtatatttgtagatttgcatctaggttatgttggtctaaagttttgtttgtttgttttccttttctttttttttatcatctttgtcttcttctgtttaagtgtcatgcttgcttcataaaatgaattgagaagcatttcttcctcttctgtttctcgaaaattgtagagaactcttgttttttgttgttgtttgtttgttgttttgttttttcttatttttatcctcatactgagaaccaaacagtctggagtgtaaaacatggttcctcattccagttaaatctagtatacaatgacaacaaccctcttgggttaagcattggcctacaaacagaaaaaaaccttcagggagatagatgctgatctaggcattgtgagaaaagctgaattcatttttaatcatgaatggcttttaaggaaagaagatttattaactaaaataaatagattagagggaattctcacctatgagagaggaagggatgggattcaacctggaaaaagtaatgaagttttagtgaacttggtaaggtagactcaacaattaatgatggataatgctaggacccaacactggtaatgagtttgtattatgactcaatagcatcactttatcactttaacacagatggaggcctaaataaccatagggtaatggttcttcttagatgcagaaggacacatttatataatcttagggaccccatctctgaggtcactcataatttatattaattcattgttattgccattgccccaagaatagataaggataagacatcctgtagtacaggtagcagagatataaactattcttattcttgtgtcttgtctataggaagggagtgtatcctggtgtaagacagcatatagtagagaccattgtcaattagggcctgtgaactaagacagggtgactggctaagtccacaacccattagaaacccagaaataatcaaatcatggtgagtagtaataacacttatttataatactatacggtataaagacaagaaccaattatgttgagtagctgtaacaaatagctctatcattcgtaataactttttctgtaataaaactgaattgtaacatgatcatactgcaatatgacattacactagcattgttggtaagattcaactatcttatgtagagaagttatataatgcttatattgataatcaaatgtattaagatattgagttaaagcctcttcagaatgtaatctgggtgaataataaatggcctgagaaaacagaattcagctaaccattatctaatttcaatgctaaatagttctgcacagatttatcaaaaagtaaaaataaaagcagattgagaggaggaatgaataattttgtttgtacaaaatattaaagtgtatgtaatgggcttgtaggatgcattagtaatttttaaaaatcaatctttaccctacactgtgtccataaaatgctaggcatattcatgttaatattactgttgttactgtcatataaatgccatattcaatgtagatgctcagaaaaatatgattgttttgctacaggagagattagaccagggacaataaatatggattaggcaagaatgtgttaactcagcagcccagggttttttcaaccctgcacattcaaaggtaaggtttgtttttaggactagctagcctctgagttctggaaatagtcttaccgtgaagagtgtttttgtatatctgaggccttgggtttatggtgaatgactgacttatatgcctgaggccctgagccatgctgtatttatttgaaccatgtggtatcaatttaaccagatacgtttattctaagatatgatttatgctgaatgcctggttttgttctagagggatcatggaaaggaagctgaatttgccaagttttgccacttgggcattgcatgcctatgtgattaaccaccaataaaaacctgggacatcaaagaataaataagctgctctaattgccaagaattcacatgtggttgtatgcagctttactgggagactgaagtgtatctgcatgtgattctgctgtgatggacacttgtaagtttgtgcctggagtctcctggactttgccctgagaatctttttcctttgttgatacgactctgcatccttttgttttaataaactgtaaacatgagtataattgcttctctgagttctgagagttttttaaataaataatcaaagctgaagagcaatggagacccccaccaaaacatctttacacatttcaattttgtattgaagtaaattttattttcttttttatacctcccatatatattctatttttctcattattatttattttatcccaaatcttttatctgtgatcattttcctttgtttgaaatttgtcttttgacgtttctttggaaggtgcttttggatgataaattttctgttattctttgtctaaaatgtcattattttgactcatttataaaaggagtttttgtgttttataaacctctaatgtatagaagtgtgtctaaactcattgaggatattttccaaattttttcctactttttattgctgttgataagaagtcagtgttggtattttgacatttaagttatgtgtcattttgttgtggtagttctgaagatcttccctctgttttatattctccttcacctttcataaatgtactttatatttatttggtaataaattttgaacatatactatgctataaagataatctaggccctttggttacatcttgtaaataaaatcaacaaaatctgttttgagattatattgtaatataagatacccaaagtaactaggatgtgtaccatatgtttgaaggtggtaaatacgatgagaaaaatagatcaggtcaggaagaatgaagatgattgaaggtacagtttatgatgaaaacttaggtgtgccgaggaatgattcatcttatgtatcttgagtgtaatgtcttatttctcctgaatctgagaatttgatgtctttcattagggatgtcagtaaatctcactaatgaatatattagactccagtttaatatatgatagtcattttcattctgtctttcatatcactgaatcctttctctttattgttcatttttatacatctcttaatagtcaaagtgaatttaactatgttttacgttatgtggttattctcactttagctatctctaacatattatgaatgtgtcagttgtgtgtttaccgttgtttgaattaaacttttaaatcattcattttaattcttacttaattcaaacttgtttgttatacattcttataattccagtatctggagtctttcttcatgtgattcttttatctccctgttttcctcctatattcttttcatgcaccatctttctctgtgtgttttgttttgttttactgtcaattcctaactaatagaagtatatttatgcaaataattttaggatagaattgaaataggtttcccaaaaggattatataaatttgtttgtaccaagggcccagggttataaacagaatgagatcactttaaatttctgtcttgaggattttcaagttacacaggtcatattagtgagaaccccagaaaagggcattctttttttttttttatatttcactttacgtcctggaatacatgtgcagaacgtacaggtttgttacataggtatacatgtgccatggttgtttgctgcacctatcaacccgtcatctaggttttaagccccacatgcaggtatttgtcttaatgctctccctccccttgccctccacccccaacaggtcccggtgtgtaatgttcctctccctgtgtccatgtgcagaacctgcagttttgttacataggtatacatgtgccatggtggtttgcttcacccttcaactcgtcacctacattaggtatttctcctaatgttatccttcccctaggcccccgccccctacagcccctccctgatgatcccctccctgatgatcccctccctatgaccatgtgttctcattgttcaactcccacttatgaaaacatgtggtgtttggttttcctgtgttagtctgctgagagggatggcttccagcttcatccatgtccctgcaaaggacacaaactcatccttttttatggctgcatagtattccatggtgtatatgtgccacattttctttatccagtctatcattgatggacatttgggttggttccaagtctttgctattgtaaatagtgctgcaataaacatacgtgtgcctgtgtctttagagtagaataatttataatcctttgagtatatacccagtaataagattgctggctcaaatggtatttctagttctagatccttgaggaatcaccatactgtcttccacaatggttgaactaatttacactcccaccaatagtgtaagagtgttctcttactacacttccaatttggctggactttgaactttgtctctggtcccctgctttttacagtcccaagaaacatggcctcatccttatcaagaccagagaatgctctcaaggtaaaaccttaattttcataaaattattgtcttcttgcctgatcattgtgacactaaagcaagatttttttaatgtttcatccaacttttaagaattattttagtggtaggactgagccaggtttctaatccacactactgcagataaaaaaatgacaaaaggtaactttcaaaaatagaggccgggcgtggtggctcacgcctgtaatcccagcactttgggaggccaaggcgggcagatcacgaggtcaggaaattgagactatcctggctaacacggtgaaaccccgcctctactaaaaatacaaaaaaaattagccgggcgtggtgtccggtgcctgtagtcccagctactcgggaggctgaggcaggagaatggtgtgaacccacaaggtggagcttgcagtgagccgagatcgcgccacaggactccagcctgggcgacagagagacactccatctcaaaaaaaaaaaaaaaaaaaaaaaaagaaattcatcttttttcatgaaagatttattatacattctaaataaaatggagatagaaagttagcatttgaactttaaagttgttagcataaggagcaatgaaaactaaatttctcctgggagttactcatttttctgggttgtaaatgaatgccatattattttttgatgtttaatgtaaaatattattgactgtaataatccaatatgatctaggatattcagtcttacacaacatagggatacagtataggttgatgtacatccaaaattataacacactttgttcaaacacaatgcatattacattttcctgtagctcaaatctgtgttatctgtattattaagagatataaggagaggattcaaaataatagctgaagaattctcattaattttatgaatctagtagatcaaaatgttactctaacattaataatttcataatacagactgtgaggcttacataaatctgtttcaaaaaatgtatagcactctttagctttcatgttgtaagacattcagaatataatccaaaataaagttgtaataaattattgcattttaatgagtattttaacataaaatgtgagtttgggattattataaatccaaagacacataaactcagtttctaaaagatatgattgaggggaaatcatgatttattatatcttcattttatcaaaaaaagacacagttattatttataataaaaatgattacaatgcacacatactcttttgtgagttgccacagaattttctattaccaaaacctgtcaagttcaacacatgtctagaatatgtataaataaaggttgatctgtgatattagatattatcaaataaaaaatactcttattgaaaaaaatgtgattccttatgacaacttcagggcatcttctatttgccccctgtcatcaacaggggaaattttctttcctacatttctcactaatcatttctgacaagtagttggcaagcttaactataaagggtcatccatagggttctaggtcaaccttaccctttgggaagaaagtatacatgatgtctatgaataaatgccctccaacaaaggaaaaggacaatgctttacatagtgtgtgcataatcatttttcaacataattagcttatttgtgacatgattttactgtcattgcaggtgtttgacatgacccacgctttttctttgtgccaagaaatacaatggttttgtattacattaatactctagatcatctataatatgagtcaggtttggttaaaaaatatataaaaataaaaatctcagttctatttaaaatactaatgaaaatatcctaccaaagtaagacattagcaatgcattatctgtcacttgatattttgtgtgtttgctcatttcaacaagggaaagagaattagaaaattggaagaaaaatatttaagtaattcttgtaaaattaatatacatattaaatatcatgaagggtagaaacagagttaacatttaaaatgtttataactaatgtgtaaatttaattgaaagccaactgattgctctgaaattttatgaggaataatcacaattgtacagaaaataactgacaccgaaagtatctaccttttcacatttaaatgcaagtgactttttgttcattcattcaaaaaatatggattattatactttagcttaaatgtttgtctcccctctaaaagccattttgaaacttaatcctcaatgcaatagtattaagaagtcaggcctttaggagtaattaggccatgacgactctgtactcatagatgggattagtgcattacaaaagggctgaagggaactagctaatgtaaggacacagcattcaagttaccattttagaagcagaaactgggacctcacttggtgccaaacctgccagaaccatggttttgaacttttcagcctcctggactgtgagaaacaagtttctgttcttatcagtctcagctattttgttacagaagcacaagcgaactgagacctgagatgggagtgtttatgtgctaggtatggagctaatttctgaataaataaagatgaatacattctatgacctcatcatctagtgcctgttacagtcatgcagtggatattttttcttgccttcttattactcatttttgctctcctcactaaatattgaggaaaacatgaatgcatcatcagtttttccactgatacaactgtttaagaagtacatatgacattatattttttctttctgtattctgtagacttacctgtaaagtctaaggctaacattgactttatgctaattagtactgtgttcatttcagatgtgtaatatgccttgtacaaatataaatagataaaacattaaaggtgctactactcaaaacacacagggaataaaatattctatttgaaacatcaacatagagtttacactgagggaaatttttattcattagtttaaatggggcaaaatacaataaatattatttggttaaaatagagaaagttaagtggaaagatgaaatgatgaagagcgcagagaaaattgttcagtttgcatacaaattgggaaattaacacctaacctgcctaggtagaatttcatagcgttaactaaaataattacttaaacttacaagatttattagaaaaatatgaatagaaaaataaaatgcattgttgcattttatgtaattttacttgaacttagtttataacatgtacatagattaagttgatttaaatattttatgtacaaaaaactatattgttgaagattctaagagcttaaaactaaaatacaagataaacatttactttacaaaaatagtaaataagatgaagaatttgaaagaatttaagaattaatttcagtttcttttccaaaatgtatgtggttagcctacaatgcttttacaatctgttattttatgagtatgaatattgattttattattacctaaacatgtattatttttaaagtatggcaaaagaattaaagttctatagtttgacaaagctgtaaagcagatcaatcctttgacagcttaatgaataaagcatgcatgtagttgacactaattcatttaataaacatttgtagaacatatatgtgtaagaaattgtgctaaggagatgaatggcacattaaaataagaagacaagtttccagatactaaggagtttatgtaactgtaaggtacataaaacaatacaaatgaaaaggctaaaataagtcagaaaatgaagggaagaaaacaaatatccatattaagtatacataatatctcaaatattctttaagatgtcttaaatagattttaatatttaatcctaatgacaggataatctgatttattacagatgatataactgaggctaatacaaatctgttgactttaaattttcaaagtcttcctgaattatttgactgtataatattttggtaaacataaataagtggatactaatgcattgaaacagaaacagaatactgttcaagaaatagaaaaaaatgaaacaatagaaaagattgaatttgtagtatgactacaatttaagatttaataaagacaaaaatagaaaccaatatgtagttaggaggatagaaaaaagtacagtggaccctccatatccataggttctgcatgtgtggattcaaccacccatggatcaaaaatatttggaaaaacatttatgaaaaagtgaacacatatggaattctgccttgtcattatcccctaaagaacacactataactacctacataacatttacattgtacttggtatcataagaaatctagagatgatttaaagtatgtgacagtgtggatgtaggtgtataaaatactattatacatcattttatggaagggtcttgagcatctgtagatttttgtgtctgagggttcctagaaccagtaccccacaaatacaggggaacaactgtaatgagttcctagtaaactaggctgaagtattataactgtacacaaaataatttaaggcagaatgattaaataatatatagcagtatgtataagaagtgaagataattgaaaattaaattcataggaaagacatgacaaatataatgaaatcaatggaaaagttaaaactttagcaagatgtacaagcaaggattgggtagatttcatctgaaagatgtaatttctaatgacaaagtactttaatagtctagcctaatattttattgtaccttaaaacttccctctggctcattctggtcttatcacaccagctttcttatggcttcttttatctgccaagaattatgctctggtctaattgacctccccaaatttgtatattaaaattctcaccaccaaggtgataatattaaaaaatgggcaatttggtaggtgactggatcatgggagtggagcccttatgaaaggtgccagagagacccctccctcttccaccatgtgaggttagactgagaaatacatctctgtggtttataagcttctcagtctatggcattttgttatagcagcccatgctaatgaatacagatgaccgtgtgtctgcagaccttcctaggaaattattgagtccttcattgaatactaaactgtgaatacatgagagaaaataacagaagcctggggtaaaatgccaacacaaagggtttgaagaacaattctcaaagctcaagaaagctctgcaaatattattgttgccacaaaccaaagtagaagacagggtaatatatgagctattaggtagaatctttggaagaatcctgcttttgtgatggaactcactcattcctaaacctaaagcaactctacatcttctctaagaaaattttatagcaatctctaaaagcatcaaactgattccaaataatttaactgtgtttgagaacaaaatacaaatatacaaaaggaattcaacaaaatccatcacataacaatatagaattcacaatatctggttttgatgaacataataattagtgttgaaacatgttaattcagttgttaaaaatatgctttattttttcaaataagatgggaaaatatgtatattatgagaaaataaaaatggaagaaataaaaacaagcagactcctaaaacagaaaaaataagtatattagattaaaaatgtatgaataaatttaacagcactttaaccattgtagaaaaaataccagtgattttgataacataacaatataaactatccaaaacagaaaacatagacacatttgaaaaaacaaccacactgtgttggacaatatcaagcagcataatacaagaagagatggagtcccagaagaacactgagtggatgtctgtgtgtgagtatgtggtagggaagaacaaaaccaaaaatacgaagaaatgattgccaaaatgttattagaatcacaaataaagacaaaatggcaaggtaaactattgtctaatttctgaaaatcagtgataaagagaaaaatcttaaaaggcatcagagatgacaaaataatccacatcaaaagaaatacacacacacacacacacacaaatacgggcaattttcttcagaaactatgaaaacttggagacaatggagcaatcataaataattaaataataaaaaacagctttatctacatttttataacaagtagaaaattttaagcactaaagtaaaatagggctcgtttatttttagaaaattaaaaataggtttggaactagggtaaagtaaatgacacaactaggtcccaaaacctaaagagctactcactttcagagttatatatttgagattgagagtgcaagacttgtgccttgtgtgacccgagagagttcctcattaagtttttcaccagaggtaatttgctcatctcaacgttgtctcagcactgagcaaaatctaaagaatttcattgtcagccaccctccattgtcatttataagaaagagtcctaaggcagaagtaaaattttatgagaagtatatgtgtgtctgcagaaaaaaactggcaatgtattatactgcatatcaagtgatatactgttatttgaaagtaggctgtgatgagttaagtatttatattttaaaacttaaagtagaagtatttatattttaaaccttaaaacagaagtatttatattttaaaccttaaagcagaacctaaaaaaaagtacattagtaaaccaatagtagaaataacataaaataatgaagtacatatttaactaatctacaaaatgtaaaaaaaggataaaaaattgaacaaggagcatataagataaatagaaaacatagcaagaaggtatatttaaacctaagcttattcataatcacattacattacatgtaaatcattcatacacatcaatgaaaaatcagaaatctaattctgtctactaaaattctactgtaaatataaatacatagatatctgtgtgtgtagtacaaacaaaaatttatagaaaactagagttactatattaatgtcaaactaaatatatttcagaacgaaatatatgaccagtgatagaaaatatactcactgattataaaggggtcaatttattaagataactaaacaatattaacacaaagaaactatacaagttaaggtgatgaatatcagaatcctgatttgataattgtatgtcatatgcttgtatgcatatgtatcccatacatatgtgcaactattatgtatccataataattaaaaattttttagaaataaagaattagataaatgtaatagtgccatgtgtttatgttagaaaagaaaaaagaatctaatcagttcctaaagcaaattaaacccaaacaaaacagaatgctgttgtctgaatgtttgtgtctcctcgaatttcctatgtagaaatcctaactcccaaacttatgttattaggagatggggtcttttgggaggggcttaggtcatgaaagtagagatctggggctcttttataagggtactaaattagtactacattaaggatagtaaatgagtagttttcttacataagagaccccagagagctaccttgctctttccattatgtgaagatgcagagagaaggaaccatctatgaaccaggaaatgggccctcatcagacatcaaatctttgagagccttgatttcagacctctcagcctccagatctatgagaagtaaatttataagttataagtttatattattataaattataaaattatgttgtttataagccacaacaaaaaggtatttttctattgcagtcaaaatgtactaaggtacaaagaaataataaaatacatataagaacaaaaatcaataaaaattgaaagaacaccaaaatggaatatcaataaaataaaaagctcatttattaaaaaatgaaaaaattctagctatactcaacaaaaaagagaaaaaatactaaatactaaagccagtaatgaaagactgtcactaattatactacaggttataaaatgatagtaagcacacaatgtttaaactttatgcaaatacattttaaaagtttggtaaacggacacattacttgagagaaaagaggttacaaaattcacttaaaaataaagagacaccatgaataatcctgcatctattaaatacattaaatctataatttgaaactcacatacaaaataattccaggtcaggaaggtttcactcttgtattctcacaatctttaaagaataaatagtaacaattctatgcaaagtctttcagaaataaaagaggaagcaaccctaacagtacattatatgaggtacagattacccttaaaggaaaaaaataggtagagattaacagaaaactacagatctacattttgatttaaaaaatttgtataggattattttattaaaagtagaaaagcatttgatgacatttcacacatattcataataaagacttacagaaaagtaggcaagagaaacaaattatttcaaaagtaataaacatatataaaaatagttaatatagtgaaataccaaatggttcctcctactataagaaagaatgcaaaaatatccactatgaaccattctgtttgatacttagaaaactgcaatacagtgctgagagacattaaggcagacctaaataaatggacagataaaccaagttcaataatttgaatgctttatagtgttaagaaggtagttctactaaattgatttctagattaattgcaatatcagtccaaatctcagcaggctttttatataaataacaaatattttttcaaaattactatgtaatgttataaaatattataaattaatattgaaaatattttacatgaaagttcaaatttctggacccttttaaggtaagaggatggcagtgtttctatggtataaacactaagtatataaaaactgaagacttctattaatatcagacaaaatgggccacaaatcaagaaatatttttagcaggataaagatcaatataattggtccaattcatcaagagaacctgataatgcaaaatgttttttcacacattaacaaacaattatgcatttaaaatattcaagacaaaaacttacagaattgagaagaaaaatatacaaatccacaatatatttaaagatttgaaaactattttctgatattattaaacaagtaaataaaaaattttaaagaaaatatctacaaattcaatgacattataacctaacaagttctaggatgcatggaatattatattcatcaccagcaaaaacttattttattttccaagtgcactgacattcatcacatgttaggtaacaaataataaagtttcaacaaatttaacaggattagatcatggagagtatgttctctgacccaatagaattaaatttaaaataaaaaacaaaaccaaaactacaatgaaatccccaaatatttagatataataaacttctaatgatgccttgtagcaaatagtaaatcaaaagataaattagaaagtattttggtctggataaaaataaaaacactacaacttcaggattcctttggagaaatacgaagtttttaatgtttgtattagaaaaaggagaaatgtctaaaattaatgacacaaatgtctacctgaaaaagtgaaaagaaaaccaaattaaacaagaagtagaaagtaaaatatagagaaaaactaaaattttataaagacataacagaaatacaaaaggaaaagatgaaatttaaaacggattctttgataaaaggaataaactgaattaaattctagatagtctgagaaagatacaaagacagaaatctgtcagcaagcactttcaggaaataaagtgggcaaggttgggaagatggtgggtgttgtaaagatactacaaatatctaaatgataataacttaaattataaaaactttatgccaataaatttgataatggttgaataaattgtatggttagcaaaataatctttacaattactctagaataaataaaatttcttcatatctttagatttattaaagatactgaattttaatttaataccttcttaggggaaacaaattccagactcaggtgccttcactgttaaatttcattctttttaaataggtaaatgttacagtgattattactcaagtgtatatcctgagaatttttacaataatttgttacatagattaacttttttttcttcaaaatacaactaatttactgattatactttttgggtcttctattaacattattagcaaaatttagaaaatttattcatttatatacaaaattaatagatacattaaatactctgtgccacccaatgcccaattcactgagagcattttactgaataaacaaaaaattttgacccttgattaccttattgttggaggtaacaaaccatagaagatagacaatagtcaatgtaaaaataaataagtggttttgacaatggacaataagcaaaaatacctgttcacttgttgtattggtccgttctcacactgctataaagagctgctagatgctggttaatatataaaggaaagaggcttaattgactcagaattctgcaggtctggggaagcctcagaaaacttacaatcatgccagaaggggaagcaaaccatgtccttctgcacattgtggcaggaaggaaaagtgcagagtgaagggggtaaaagctttttataaaaccaccaaatctcatgagaactcactcactatcacgagaacaacatgggagaaccaccccatgatctaatcacctcccggagatccctcccccaacacatggggattataaatctgattataattcaagatgagattttgtgtgggaatggagccaaattatatcactagaatagataatatatataatacataagtaaattttatagtatactagcagatggttaattctactaacaaatacagaaaggtaaaggatgaaagggatctcttgcttaagaaagggatacacatttatatgtgttgattttaaggaatcaacaaggaatgattagcaagacttgaagagaaaggagaagccatgtgagtctctggggtggaatgttacaggcaaagataaaagccaggaaaaagcagacacttcctatattcctgtattcatccatttttatgctactgataaagatataccccagcctgggaaatttacaaaagaaagaggtttaatggacttatgtttccacatggctgggaaaacctcacaatcatggcagatggccaggaagagcaagtcacatcttacatggatggcggcaggcaaagagagagcttgttcagaaaaactccctcttctttaaccataagatcttgtgggacttattcactatcatgaggatgggatggcctgccaccatgattcaattatctcccacctggtccctcccacaacacatgggaattcaagatgagatgtgggtggggacaaagccataccatatcaccatctctgtgcaaatgctctctctcttctatttacctctgcaattctagctaaattttcctttctaagccccaatcttcaatttctcaatatacagggagagttatcctttctttggattatcctttcactgtgttttctggaaactgagagaaagcttgggataagtcagattttattttttcttttgtcagggatcagcatcctcagcttcttgtcaatggttaaaaaatcactgttgattatattttgtctgcagttagtttttatttgtgtgtgtgtgtttttgttttttgtttgtttgttttgtaaagaatttagtttagttcctcttactgtatcatggtgaagtacagctatcttcaacctattttttctgaccaatctttgtctttatattgatttaacattactttttaaatttagtcttaaaattcttactttaaatagtagttttagactacttatatttaatattgttatctatattttggccttaaatctactatcataaaatttattttccataaaatttaatctgttctttattactattttccacttttgatgctttatcttggattaagtgtttaattttgaattttattttatttcaattaataagattattagtcatatgtttttgtttattttgtcctgttaggtgctctaaggtttatactatgtaccttaactttccaataacattaaggtgactgaatatttttgccctgatacctagaaaaagacaagcatgcttgctctgataaattcttttgaagcttatactacacgtcttagcaatgcattgagagaggtaagaatacatacaatttagaaagaaaaatgtctttcttcacagatattattatattctgtgcagaaaataaaaaagatatttgcaaaaaagttagtaaaattgtgtgtttatctagatcacaggatataataataatatacagaaatccattatattttgatagatttgcaatgaccattcataatctgagatttaaaaaaaaaaacaaggaaaataagggagtgctcaaatgctaaggaaggcatgttaaaagagctgagaaacttgaatagttcctactagcaaaaatagcaaaactgaatcaataaaataagtaaaggaacagatcatgggccactgaaagaaataggaatccatgggtccacgtgagataaacccatgaattaatgaatgaataaaagaaggaaacactattattttcccacagagtgccaaccaataaaaggaaaagggttgatattgtatgttaaaaaattatcatttgaaaatcttcacattgtaatttgattgagtgttgaggcatcaatggatgctaaacctagtgggtaaatgttggagaagaaatgtatctctccacaaaacacttaattttagattaattacatgtatatatacatgtatacaatagatagtctatatataaaatatcatttcatgtcatgttatattaatataaagaaaatgaggagtacctctgcaatagagaaatctggaagacattacctttcaaatgatcaaaattaaaatcaccactgatgggaaaaattaatttcatatataacctgaagaaatatgataagaagagcatagcaccatgttggtgattttattgccaataatgcatgtcttgacacctcattatgagaaaacaccagacaaatcgaaattgggagacattctaaaaatagaatccattggaatattaccttcaaaaaatgtttaggatgctatgaagggtgaagaaggactatggaatgcttctgatttaaagaagttaaagagacatagaaaccaggaacaacacattatcctgaagtggattgttttttataaaaagcatcagggcagtttgtgaactagaatgggtcctctcttggtgattgttacatgacagctgtttgcatcaccttagcaacttaaagataaattgtttaaagataaattggcgtcgtttcatacaaacattaaagaaaatggtaatgtccaacagagtgcccacctaattactgttccaggggtcctcagaggctgttttcctactgtcttcttgatttttaaaatatattttagttgattggttttattcatgccataattggtggaaattaatccttgattctataaatttttacctagtccgtttccaatgttttttgtttgtttgtttctctttccttacttatttatttatgcttttcttttactttttttgtaaagtggaataagttaggaatgagtatattatgaccaactaaactgagtagttttatgtcaagttgcaaattatgttaagtatcaaatatttgatttttttagatttcaaaatagtcacgttttcagaaaaaatcattagtagttttctaaaaataaaatcctcttgattcaacaaaacatacttgatgtggtttttcctcccaaaacaggctcctccttgagttattgggaataagtaatgcttctcaataaagcttcgtgtcaacaaatctgaacatataacatctcagctagagcaagttactaaaaataggctcaatttgtagcttgcagtcatgccttcataaccacttttcaattaatcctgcttaattcagagaatgtataaatatgtaattttgcatgacttttaaggcagccattttattttgaaacgcaactaacgttatatgcataaattcaataaatataaagctgttttcaaaaattgaatgtttttacttgtaagttattctttcaataataataaagagatgatcactagtcagtttatttttcatagttgaattgatttagttgaacttcattgggtgttcttatgttttagtcatgagtccatgctctttaacaagctaaaggaaaccatattatatgctaaaagatgtcagtttgtgaacaatttaatgaatatatagagttacaacatttttcccgattggatgttggggtttactataattctttgttactttatatgtgaatatactcactactcactatgtttatgtatgtaggaaacatgctagtgatgaaaattcaagcagttattaccctagttttctttcattaacaaaatacagaatagaaattatctacttattcttggaggtcttaaaatatcttttcagttgactgataattctgctatcaagagctacaagtaggtgctctggccgtctatatctgtatttccatatattcaattccttactatatatttctcatttgatattctatacccaattcaaacaaaaccatttcatgtatacaatgtacttttatttatgcttttctctatcattaagtagaaagccatttgcaccttagtctaaatctgaaatgtgcctctacctaacctttctaatacattttcactatttcttagttattagaataaatttacataatttctgaaacaactttctctatggagtattccctttagtttcttttcccttccaaacaatttaatgaattacaaatatgggggagatattttttcaatgggtaagacttgacttctacaaatacatgtttaattccttctcaaaattatttctacttcctcttattcaacactgtgctagattttagggatatataataagacaatatatgaggtccttgctgttgtgaaaggtacattcttatctttggcaaattgtagaatctttagctttggtatgcaagggcattggtgtttggtacatgcttggctctttgccttaagaattgcctctttccaccatgcatatttcacctgtgtgggaattcttgcagatctctgtattattgatagtcattttgctctgacattttatacaaagctgaatcagcaacagtatgactaaacacaaccaaaaaagaaagctagaaagattatattagacacttacgtgtatggatcattatggtgaggactgctaaaaaaaacaaaacaaaacaaaaaaaaccttcagccaaaatagatttacagtttaatcgagtaatgaatgattcataaattggaaagcccccacaatcacagcagattcagagagactccaggggtgtctcatggtcagaatgaatttatagacaatacaaagtaaagtgacccatagaaatcagaagtgaggtacagaaacagctggattggttatggcttggcacttgccttatttgaacactcagctgtatgcgactagttgaagtatggctgctggaattggccaagactcagcgattgttacaggcgcatattcctaagttaggttttagtcttgtgtacctattgagttaggttgcagttcattcacaaggactgaaatatagaagtatggcgtttttctcaggccatatttaatttgatttaacaggactttgggtatgtcattgtattttactaatatattttacaaacaccccatgttatcttaatctatttaagttcacactttttaatcaaattttactttaaatgtatctaacctcctaaatttctgcctttgtgaaccaataatactttttccaaattcttattatagcatatatcagactatatagctatagacactttggcatcattgttttcccatacaaaacacaatacatttaatgaattaatgaatgatgcatcagcaaagaaggttttactgaaagtaagaaaaattataagccagtttgggtttcccaagaatcagacaccaagatggaattacacgtataagagagtaaccagagaaaacgcctttgaagaataaagagaagatagagcaagaggctgcaagagcctccagatcatgatgcaagccggcacctcaaaagaagagagagcatgaaagataattggaaaggaggagcctcagagaagagtgcagatctgagaaattgtcagccacactgaaagagcaccaaagtgaactttgacctttagatgagtccatgtgggacaagaatgaaaagccctataatatcttccttgctcagcattggcagggagcaacctaaggagagcatggcacctgcatgtaagccaaaaataaaattcaatgtccgttaaccaactaaatgggccctttatcttggccaagggcattttaaactaaacctgaaacagtaatggccatgatggaaatgggtggttgaacatgcttcgttatttactttcatcctttcggaattcatgcatagctgaacagtgttaacattaaagtagagacttaagaatgacaaaacagactcttcgtagcaataagatatcaacatgacagatagcaggccttgaaagaaatcaaagtatttcaccacaaaaatacatttctttgacatattttgaaatggccctacaaggctgtttctgtggggaaaatctccattttgtagagaatccccttctctttccaagtctttttcctgatttttcctgattccaagtcctttttcctttttatgtctgataaaaatcatttacaatctattctcagtgaagcctgctacctgcaagcttcatctgcataagaaccttggtctctaaaacaccttatcttaacccatacactcctgtctattgattccggtctttagataaattattttagccagttgtcaaatgccaatcagaaaatcttcgaattcacctttaacatggaagccttcacccaccccacccccacctgctttgagttgtctcacctttcccaattttaccaatgtgtatcttaggtgtactgattgatgtcttatgtctccctcacatgtataaatccaagctgtagcccaacaaccttggcacatgttcttaggatctcctgggctgtgtgacaggccgaggtcactcatatttgcctcagaataaatctcttcaaatatttcacagagtttgactcttttcttcaacatgcattaccactgtagtagctctgaagtggttgagttggaggtaacccaccaacaaccctcctcatggaaatttctcttgaatgaaaatatgggaggagtaaattcttcactgccaaatactatttcaaattctttcaagcataaggtaaattcattatttaacataaaagtcaatcaagaggtaaaaagaggtcacagtttgcttacgtattttctggcacttctttgctattggctgtgtcacttttacccttaacatttctgcaaaaatgtctgcagacatttagggtcatcatattcagatacaaccttacccagaagaccaagaaagagacaccaagagaaacatttatcttaaaaactcttaaggtaatttgccctgatttgcctttgtactgaattgggccatatgcgtatttttgttcttatttttggcaaagaatcaggctatacttagagtaatcacatcatacctgaatctgaagacgagacagtaaacttagagaagtactgaagccttggaagccttggatatattgaatatgttctattttagaaagaaaaggtgagataatgtatgctggcagtcaaccaacagcatatgctcctaatgaacaactggagagtcatttaagttcaatgttggggattttattagaaactgtaagatgaacacacaattcattttctctttccttgtaaatttggacaatatttgctatattcgcctatattttggcatagaaatttaggttctaagtatatagtagtgatgtagccttcttacagggtcacatagacccagaattaataatttttaacactctttttattctctctggttggctaacattaaaacaatccacagaaaacccccaagagctatgtattgaggatggcaaaaccacagatgggaaaataataaatctttgaatgaccctgcaggaaatcacagatagcattcctattatttaagcaagcaataacttttattgttttaagagttggaggtttaattttttcagcattactgttaccacaattattacaggaaatgaaaccagtaaaaaaaaaatagagggaacaaggtttattgacatctatgaggcattttctttcccctaatattacatactctagattttatttctgcacaaaaaatattctctatgtctagcctaaagaactatgtcttattcatatttatactcttcatagatcaaaagtgtgcttaaaatactgtacatttaatgagttatttttgaatgtaagcaactttgaattcatctttgcatttttaatcttatgtttctattaaatgtattattaaattctactaacactttcctcaaaataattctcaatattttggtttttaattttttactgcctttgcattctcctggcagagacccatttcacctctcctatagattatttcataaagattttatcgtctgtatcatatatatttacaatattaaaagttatctgtagcacgctctcattgttgcttatagattaggtttgcttctctatgtactactctggtaggcagtggttaaatatactgctttaagccttttcacagtaccttctataatatcatcatgcacaattttaggcacacagcagaaaatcaatgaaacatatttaattgactaaaaattgaaaaacattggtatatatgtaggacagatactgatatttttataagcccaactctgaaatggtgatgcataaaaagttgataattccttttagcagaaactattaatagtcatttttcaacataatgcaaaatatatttgagattgataaatattttagaactcaagtgcaagaaagccattaagggaatcccacaatttttgttgtttctaaaacctaatataatttaagattatgaacagccttctttctcagaagaaaaacatatcaccaacccaccacattaaaaaaatgcattattccaatcaatcttgttaatataccatagaaattgaattttttaaaaaaattcagaactttaaaaataaatactaaccataatagctcaattaaaattatatctatattcttggaggttttcaaatgccatatctaaaaacaggatatagtaaggtatatccagggataaactagctgttaaaaaataattgattgagacctgttattattggctaagtaaacttctcttaccttccaaaacatgttccattatttcataagatctagaaatgatatcaagtttgaaatttgttgaaatgttttcctattgacctacttataaatgggttatttacatattcagcgtaattacttgtgcttaaaactgttttcaagataaatttgaactatgtcattgttcatataaaagaaagatgcttcttttcaattaatttgtattagttaataattctacaaattgtgtttatttcaatggagattaaagaatataaaaagaataatgtttctgttttagactatactttattagtaaaccatttggggggtggggcaatgaggataaactccatcaaaggaacataagttagaaaagctgtaacataaacttaggttataagtctgaattaccctagacagttagtctatggaatatgagactgtatgcagcctcagctggaagcactgcccttaagcaaagaccatgaaagagatgctgaaataattattcaggcagaaatttagtataatatttctttgggaatgttctccaatagttggaagtcaaaataacaagtaattctcacttccattctttgtcttctcaatatacatccctatatcttgcaaggcatttagcaaattaaagtacatttaccagcctctttgcactttgatgagtcaatgtaactaatttttggacgataacgtgtgaacagaagcaatatttgcagcatctaaaagaaatgtgtgtgaccttttacccctgttaccatgctttagaattcatagctgttttcagctattttgtatataaaataagcatataaaagcgacaaaataaatcaacatcgtagagctatcgtgacatcactggacttctcctaaaacttttacatgaaaaatatgtgaattatttcaagctgctctacttgtttttcatagactctgtcattaattaattttttatgtaccactaaaaagcattttaaaatgcctctaaactatggcacactgctaaatattttctagatgcctcaaaaaagtttttatatgcagtaattttgttttacatacacatgcacacttaactgatttcaagttttttcaactttcatatgaaattgaaagttaaaaaggcacatgaaatgtctttttgaaattcctaactcaatttaatttttttttacatttaggtttaccatactgttttaacaaaatgctccgtatttattctaatatttttaaaactttaggaataaattaatattttggattgttctacagtattgtatcctgaactggaacttttattactgatttattaattgaaatatgaaatatgatatgcacatgtgaaagacacagatcttgagcatatagcattaaacatttttagaacgtaaaatactaatgtcatcacaacctacatgaatatgaattgagtattactagaatccaggagtctctatagtgaacctccaatcattactataggcaaccactgttcttacttttatctttataaattacatttgcttgacattgaacttcatagaaattgaaccatacaatagatattaatttcaatctggttcaaaaaaacacaaccaacagcgtgggtgtcagtgtgatattctgtgctgcttctcagctgaatcaatggtgctgacagctgcaatagcaacagcagtgtcttcagaagttttactgagagtttggagtccagagtttctgcctaatggcagctgcgctcaaatagggccaatggtcagtctggaatcatgggacccagaatgcaccaccttcccctactcatttttcacagttaaggatggaagtggcttccttcatttgctcatcatctggagtagcaggccccttttgctctttcagtgtttctaacattgttgtaaccacgcccccaacccctgtattatattgtctatgctttaaaaactatattgtggacttgaataaaatttattttcccattcccggtaaaaaataattgggtcattctttactcatgtatcaattcaaatttctaagactctatttatctcttctcctcaataatgtttcttttttcttttgcttttttttagacagggtcttgtgctctcacccaggctggagtgcagtggctggaacacagctcactacagccttgacctcttgaattcaagtgatcctcacacttcagcctccagagtagctttgatgacaggtgtgtgccaccaggcccagctacttttctttactttttgtagagacatggtcttgccatattacccaggctagtctcagatccctgggctcaagtatcctcctgcctccaactcccaaagtgctgggattataggcataagccaccatgcccagctaatgttttctatttaccatagcttttcacatatatatgttattatatatgtaatatacatatataatatagtatggatgtgtatatactatattattaacaattagatctaaaatatagaaagaattttaatacctttattttctgtaccttcatagttaatctcatattttccaaatctgttaatgtggcactggtcagttatagctccaaagaatgagcatccacttaatctcataaccaggacccaacctgcaacattagtattacaaattaattcctaattccagtctcactctttcatcaccagttctatctttgcacacttactaatcccaattattttaaagcaagttgcttaacctgctgtggcagttttcccctctccttcaactttctctccctttttttttctcctaataatacctgccaagtaagaatccctttcattacatacatcaaatagccacttcttccaacaattttattcaacctaagtattcaacctaagggcttagattcatggtctgtccttacaatgccgttccatctttttaaagctaattgcaatgcacctagtcatttttattgcagcactatgtatgatagccaagatacagaataagcctaagtgtctggcaacagatgaatgcaaaaagaaaatgcactatctgtatacaatgaagtactctttagccataaaaaataaaatcttgccatttatgacaatatggatgaatctagaggacatcatggtaagtgaaataagccagacacagacagacaagtacagcatgatctcactcataagtggagtctaaaaaaaaaagaaaatacaaacatttaaaaaagttaatagcatagaagcagagagtagaaaaatgttaccagagactaaagacaggaggacgaaaagaaggatgaggaaactttgattggtggtataaaattacaactagataagagcaaaaaattctggtgttgtgttgcacgtagagtaagtatggttaacagtgaaatatcgtatattacaaaatagcttgaagagttgtcttcgaatgttctcaccacaaagaaatgataaatatgtaagataatagattcactctgaatggatcattatacaacatggataggtatccaggtatgaaattataccccatgaatatgtacaattattacatgtcaattaataaataaataataagatcactagatttaatcgagactcttattgacttgctctcattttagagttttaaaactagtctgccctattgcaaactacctatttttaaaactactcttctcctgcacaaaaatttctcaaagtctcctttctcctgaaagaaaaatgacctatttaatttacaaatatttcaaaaattagtacacaacattttatatatgaaaagaatgctgtagactgacttgcaaataacattctaagattcccattacctttaagaggagtcagctgtcattttggaaaaattaagatttcaacaattttacacatattttgaaaataattttgataatgaaaaatgttcaatcttaaatcgtgtaaataagtaaatagagaggtaaaataaagagcttgatgtttatgtgatattgagaaaaaatcttttttaaaagtaaaatacagattaaaatacaactttgtgctttaactgaagggtgtccctactccctgatgtgtttgagactgtcacaaacctgaacccatttggacaatacatcaaataatcattttgcatcatttcactattggggaaatgataacttcttacattaaatgaaaaaaaactgaaaaagtagtattactttgtcttttaagtggcaagatagggttgatatgatgccgaagtacaaacagtagggactaagtgaggatggaggatatatgaataaatgtatcaaaagtcaagagaaatgataaaacagacaattctggggaacagtagtagaagctatgcatggaatatggttagacagacagtgatatttacttttgagttttgcttatatatttctaacatttcttgataggactggcattctaacagttattcttattgttataaattcttttaaaaatactttttctccaaacatctcagttcaaattatagagttaaaggaaactatagtaataaaataaaatattaattatttcaaaagaaaaagagaaaaatttgtacacttaatttaaaattgttttcagtcttatttttgcaagcaatttaccaatagatttgtaatgcacagtaatgttgaatgagtattgaagctattgaaatacagaagtaagtcagtttttcattatgctgtgagtgatgtcctgaaacacattaacttgatattttatctattgtttaatatcattccccatgaattacatataatggtaatagattaatatctttgggagtactgtaaataattatataattcagccaggaattaccttgttcatttgctaacattgttatattctttcaaaagcaaatagcaaaaataattttcaactgacatacatatggaatacttactcttcaactatctcaaaatgcccagattttctccataactttcctattgatttaattataggcattagaaatgagtattctagtacaagaataaatagtgttgtctctccttcatcccccagtactcctaaatatttactaaaaatctcaatgctaatcaatagtggaagtatttggtgcctaatgatggcattccattccttccttgaagtccaacacacagagtaatagaaatctcatgaatgtgattgtgtgaggttgctcataatacttggatctatagagagaatcacttaacagacattagctgaatcagaaactacttctcatttcattgagttctatgtagtccccaacctttgtggcaccagggactggttttgtggaagacaatatttccacggacaggggagcagaggatggtttcaggattgtaatggttaataataggtgtcaacttaattggattgaaggatgcctagataattggtaaagaatagtttctgggtgtgtcagtgagggtgttgctggaggagattaacatttgagtcggactgggagaggaagaccgatcttcaatgtgggtggacaccatccaattgactgtcagcttggctagaacaaagctggtggaagaaggtgggataagctgacttaatgagtcttctggctttcatcattgcgctgtgctggatgcttcctgcccttggacatcagattccaggttctttaggctttgaacacttgaacttacagcagtggttttccaggggctttcaggcccttggccacagactaaatgttgcactgccagctttcctacttttgaggcttttgtagctgaactaagcctttgttggcttccttgcccctcagcttgcagacagcctatcatgggacttcaccttgtgatcatatagtcaattctcattaataaactccttttcatatatacatatatcttataagttctgtccctctggagaaccctgactaatacaggcatgaaactgttccacctcagatcatcgggcattagattctcatgaggtatgcacaacctagatcccttgcatgctcagttcataatagggttcacattcctataagaatctaatgctgtagctgattcgacaggaggcagagctcaggtggtaatgctcactcacctgccgctcacctcctgctgtatgatctgattcctaacaagccatagctcataaccaagggttgaggaccactgtgttaaaagataaactaagacacaataaaattttaaatatgttatttacacaatgatttatgactcaggcagctccaaaccataaaagtggcttaagagcaccactgagggatcacagggggaggcttttagaggacaggcacagaagaaaactaaagataatatttgactatttatagttgtacagttatttgtaccttatttggtaccaaagttgtacgttattaggtctatcccactggaaagtcttcagttgtatgattatgtgtgttggctacttctgattggttgaacttaagttctgtttttctttaatatagaaattgataatagctcaagtttcccttatatctgtagatcaaacaaggtttagatcacttatgatgcctaactggttttgtctgctcagaaattcttcaggcctggactccattttaatttactttaatgattgttactttaaatttggattaaacagtggattcatatgtactgagtgaaaaaaaaatggaaatagatgttataaaatttatttgaaatcattcagccaggatgttttaaacagcataaattagcagaattaccaaaaacacattttgaaaaaaccttgaagcaattttaatgtattgcaaaatgtgaaggagactagtaggacaaaaacttaaaggttgagtttgagatacgatgcagggttttttgctccttagcccagctaggcctaagttctgaagaagtaggcacatggacgctcaaagagtaagtgtagtagaatttatttagtgaaaggaaagctctcagcaaagagaggggtcctgacatcaagttcttggttgcccccttaacagttgaatacaagggcattttttttcttgagacagagcctcactctgttgccaaggctggagtgcaatggcgtgatcttggctcactataccctctgccttccaggttcaagtgattctcctgcctcagcctcctgagtagctgggattattggcacatgtcaccaggcccggataatttttgtagttttagtagagatgggatttaccatgttggtcaggctggtctccaactcctgctctagtgatctgcccgcctctgcctcccgaagtgttcggattacaggtgtgagctactgcacccggcaacaaggacatttttatacaagctgatagggctgtgaattcctggttgtatgagacatgaattcctggttgctccactccacctttccagtgagttatgtgggcccttagtctgtgcctctccatattgatttatttcctttaatgcacatatgttaaggaacgaaattttccactatgggcatgtttaggcaagctcccttagcaagtacgcttatccgcacaaaatatttggtataaacacctggggggtgggtaagaggttctccaggggaccctttcctgactgtctccctaaagcaagttggctgactcctttcattcctcccttcaggagtggagaccccaaattctgttggggaaagtgtacaacgactgctcttaactgcttcctgctgacaaggggtgctgttttgggaaagtggcagttaaggctcctcctgaggtcagtttaagggtccccaaagagaacggtgtgttcatgagtggttctgtttgcatcaccatttgatgttgaacggcctttaagtgagaagaaacaattagggttattagaagacatattcaaaatgaaacaaagggataaggacagctcaaaacaaaacaaaacaaaacaaaatctcaaggctgccaatacagccagataactcgtggctatagttatgcctgctaaggtttgtattcatggggcttggctttgattagctcccttggtcttattttcccaaacaaagaaatctctgggttatgggcacctatttactccgatcacctggaaggatttgcaggataattgttcagaattaaaatattgatccagattttttatattactcgtccctttggttcttttgagctgcagccgtacattgctggttggtccacaggaacaagcagggtagtctaaaatgtaggcaaaaacttaaaaacaactaatgggattataatgtaatgacaaatgtagaatacgttttgaaacataatttctctctctccagtcctcatttttgtcaaaaacaaatcatgataggactcagttgtttgaaaaaataaactttagccttatacttgtcttatttgcataaagtgcaaaaagaataattatttttcccataggcttttaaattggctttgatggaactctgttccataaggcatctcagttaagaccttttaaggccaagcccagccaagggtttccaccctcaaatatctacaagtttggtaaatcattctcttcttgatgtcccaagaacaagctttttaacaggctcctaagcctgttaaaaagtgacatgctttactccccatgggttaggaaccttgtacaaggactgtgttgacaaggtatgtagccagttttcccaagggacttttattggcaagtccagcttaatgacttaaaggaacatatacccttccagtaaaagccttggtaaaacccccagtttcttcaattgtgtcctgttgcaaaagaaaatgtattcttattgcactgatgaaaataactgaattgccataaattaaatattctcacaaatagtttccaaattctggcaaagccaggcagagagaaacaaacatccttcaaattttgttcacaggcgtatagtttactcaattattaaaggttttaaataggtcaaaataagtatccttgactcagaaaaataaagcaaggatcaccaaagttttaagcaaaaaggttaaaaataatacttgttttctattagttcaatccattctgttctcttgttctgcttgatattcatgaacatttcagttcttcatgagtactgtatttttttcaatgtcataatctccagagttaatggaatcttgcatttgagaacacttgtcaaaatcctatagctgattataaatcatcttttgagtaggatcaaaacaagacatttgtctgtgaatgatgaaatgtccagggtagttactgtcaagaatacaattgacaaagaaatttagttatttctagggtttacaataactaaacataataaccttaattatgattgatagcatatactcagacattagaattttagaaatctcatataattttgaaacatattaatattattcactaaaatataacctaaagcagattaaatacaactttggaaataccatataactaaacatttcaaaaaacccagttttcttctgttttggatgttccagggaccaggaaagacaattttaaaactgaagtttgattttgggaagactgttaattacgttagaggttcaaagcacttgatactataaaatagaattccaagttaccacatgtcatttattttagccaaaatgatgactcaaacattttaaaacaacgcaaaagcatattcacaggaagagggaaaatttagctttccaaacaatctgtcgttaattttacagggaaatgctgttcaagtgaaagcctaatttcatccttgcattagtctactgttgatgtcaaccctaatttttttaatgaaaacttatagataattatatctaatcttatctagtttgaccatgaggtgagatttttttaaacttttataaccctttacaaattgttgttaaagagcaggtcagcgcctttagaaaaccttgttgtgcttttatttcaatgctcaatttacaaaaacaaaatacttttttgaaattagccaatatgttcacacaatttcttttgcaagattaagttttacaaacttttcaccatttgtttaaaccttcagctttatcttatctaattcaaaacaatcctttaacccaaggcaaaaatttacattttcatgcattcttataatcttttactaaaaacatattttactttccttacttaccttatatgtaaatctattttcattgtctcgattacagattattatggtaactcctagcaatttttaactttaatgtaaaacctggcaagttgctttaattatgtagtaggcataaataaagtctgattccttcctgcataattaagggtgtggttaattccatatgtccctggacttattaattgtgaagcaggcaaattgaatagtgtattagtcaattttcatgctgcagataaagacaatcttgagactgggcaatttacaaaagaaagaggtttaattggacttacagttccacgtggctgaggaggcctcacaatcatagcagaaggcaagggggagcaagtgacatcttatgtggatggtggcaaaccaaaaaagagagcttgtgcagagaaactctcatttttaaaaccatcagatccatgaaacccattactatcatgcgaacagcataaaaagacccaccctcatgattcaatcatctcccactgggtccctgccacaacacatggaaattacgggagctacaagatgagatttgggtggagacacagagccaaacttcatcaaatagttcttaaaagccaaagaagcagttaataactttgaagcatttagctaacctagcatttgacctacatgattcagcccacatatttacattttaaagacatttgtattttaccaattatttttaaaacagcctttatttcttaaagattatagtcatgtgaactgaaaaggtattacagcttttatttttcttcaaaaaatatttgatctaagtgcttattttcctagagcttttttatataaacatcacgcccataagaaatataaaattacacagatgaacaaaagcaaattcagtacttgtaagatttttcatttgccaatcttctgaatagattattggcctctgggtgaagcccttcaagagcagggtctaggacagcatacagtttctagggcctaataaacaggcatagctggaagacagagacagattttgagaaggatctatccacttttaattcctggagtttcgtgaggaaaacagagggtgttttttccccaaaatggggtctgcggcaccttctttgttttttcccaggagccccgggctatcagaagttatcttagagcctctcatgtatgcactgaatgacaagacaaaatgggaaaaaaaaaatcattcaacagagaaagaacctttttccagaaaaacaagatccatgcagagaaaaatttaaaggcctttaaatatacctataacttggatatccactttgaattcagctgtgctctaagaaaatcgtttcatatctattacccaactttagccatgccgagcagccaatatttctggcttttgaactttattaaaaataacctcacaggtgaaaccaacaagcctcaactaaggttatgacttaactgtaagtgtaaaagttattttcaaagaggtgctaagcagtttttacagaatctaagatctttaaagttggttcagacaaaggaagatttaagaaaggaagctaaagttgtttatagaggggaagagaatcagcaaatggtaaaagtcacacagatattggccaaaatatactcattccctaagccgggattaaacccaggccaccattgtaaaatggcagaggccaaaagaaagtattatcaagtggttacaaggtcaagctcctaaggacaaaaaacaagatgaagaactgcagcaaggtttgttactgaccagtttgccaggctggtttgatcagcaaacttttggggtcctaggcctgcattctatcctaaggtacccctctttatgacagaactatacagaaagacacacaaagcacactacattggctacagcttaagactagcctcataaatcctttttttctatttatcagaacttcagagagtatataaacagtgatttaaacagggattttatcatttattcaactggtttgcacagggagaaggaggccagaagtctgactggtaagaactattttttttttttttttttttttttgagacagagtctccctctgtccccaggctggagtgcagtggtgtgatctccgctcactgcaagctccatctcccaggttcacgccattctcctgcctcagcctccggagtagctgggactacaggtgcccgctaccacgcccggctaattttttgttgttgttgtcgttgttatttttagtagagatggggtttcaccgtgtcagccaggatggtctccatctcccgacctcatgatccgcctgccttggcctcccaaaatgctgggattacaggcgtgagccactgcacccggccctggtaagaacttttacccttttgctggtgtaccaggcttctgagttgccctttttcatgctcagttttgagccaagcagtttaaggtttggagaaattaacttttcccagtttaagagatgcatccaaagggagtgtcctgtggtacagcgacacaatgacccacccacaaagagaggacagaggaggaaaaaggagaaaggaggtgtttttccagaagagtcctagtgattcaggaggcaatcaagagaaatatgggctgcagatgattggttactcacctaagaagaggggagcaaggcatccctagtttcttctttttcctagtaaatacctgaggtacatgagggagaggagaaaagtgtcctctttctttcttctgttcttatatccctgagtcctggtgatcttggcaggttaccacccatgggtgccagtgcagctttcacctatgttaacagggggcttacagggtgcgagttatccaccattacccatgcgctgcttgtcccactgttgtcgataacttttgagttctctggatttcatacatgccgtggatactagaatgacctctatccacgagatggaagggggcctaatcggcagcaatgagtcatgctaacctaaagctttggagctgggtcttccttaaacaagggagagaaaaggctgtcttgggaattggggtcctggcctaataagaaaaaacaaaaacaaaaaccaacaaaaaacctctcataaaagttaactccttacaaagtggagaaaagaaaaaaaaataaaataaaacagcttaagtgcagggtggggaagatgcctggaggagaaaccttttattcttatgcaaatgagttcctccaatagggagagaacattttaattgctgtctcctcctttctggctcagccaggggaggaaagacactgtgggtgcatggggagagggaagagtgagcaggaaaagctggccacctagccaagtggggcccttgggctatgtgccccagacgggaggggagggggttgggagttgccactctcccatttgtctcacatgtgtacctgtggccattggaggttggggtaagggacatgtctctaaaaacggagggagagcacattgttctgaattgtatagaatttattaagttaaaggaaagctctcagcaaagagaggagtcctgaaagtaggttcccggttgccctcttcacaggtgaatcaaaggcatttttatataagctgatggggctgagttccctatttgtataaggcgtgaattcctgtaggctccactgcatccttccagagtgcatgcagacccttagtctgagacattccatattgatttatttttcttactgcccacgtgttaagaaacaaaattttccactgcgggcatgtttaggcaagcccccggagcaagtacccttatgtgcacaaaacatctggtataaacacttgtggagcagataggaggttctctgggggacccttcccttagtgtctgcctaaagcaagctggctaacttttcagaaagagacagagaaaatgaagtagctaccaaagtattctgggtctacaagtgatattattttcaacaagtattcaaatgccattctagtctaaactaattcattataaatcagctaatattaagtaaatattttacaaattaaaaactagttacaaaaggtagagacctcaaagaaaggcagaaatgaggcaaatggggaaaaattatggtgacttaaagcctatatattgtgatctggagaattagaatttaatttgtctatacaaagtaggtcatgatcctgataagtttagcaattagagtatttataaaaagtaagagctaaataatttgtttcagggatgcacttttatttcaattatctagacctgaaattatatttttttgagatcgttcaggaagaagaaattacatgaggagaactttctaatcagtatgcttagtgtaaatatatctgatgagttcataagtctgtttcatttattattcttcagtataggtctgtagcatgacacaaacaattcctgatgacttcagctacctttttaaggaaggtagacttgctccatcccctatcttctattttgcatctgaaagaggatcatactcctgtttaagtcaactttattaatgtttttcaaaatatttcttctcttgccaatataaaataatgaaattgtagtaaaatggggattgtcttcctcaagatgagtaatttttcatgaacaatttatttaattatttcaataattattcaaaaatgatttcaaattatttcaacaatttatcttatgaacatttatttcattatttattcacaccatcaaataatattttacattgagtccaaattttttgcattgctgttcatgtcaggtttatattggaattaattctctatgacctcctttttaagcactgctaaatagatagtaatctttctttctataacagttgagtttaaattgcttttcttaattttctctgacagagaacattattttttattgttgtaaacaagctatattctacatatttaattatttggaatttgatttgtgtatatttttcagtggaagctaacttcttcctaatgtctccatctacatttcatatttattcatccattcacatattcaacaaaatttgagaatctgtttttgggcttttaatactcatcttattcattttactatttatgtttttatttctttatttatttagaaactggttctcacttagttgcccacgttagagtgtagtgatgccatcatagctcatggcagcctcaaactcctgggctcaagtttgttaattttattttaaatgtccacacagtgttctcagtcagaaacagatttcttaataatgtgtgttggctgctccttttcccagttcttatctttggacagtataaagagatccagatcatcctagtgagaggccagactctctgaaagcaagaagttaagaacaatggtttttttccttgtctttgtttttatacttataataggacggaaacggctgtttttctgtccttctaagaggatatcttctttattccaaacttttggaatgttgtaaaatctctcctggaaccaaataaccctgtatctccaagtttttatgacctatagctgtctccaaattctggaacatcatatcttttgacatatgaatacaaaaacctagtcttcctcttaccctagtacttaacctaggaacctagtaatctaaggattttaaaaatttgaccctcttaggggagtaaaagaagttttcctattgttgcaaatcagagaaattaactggacaaagggctacagatctaattctctcagtgtgtgaagagtctcaagaagctagtgctttgagagaatccatgagaaacccagggacctttaatatctcctcattattatttgcatagcacactaccaggggagatggagaattaaaataataatatattttaataactttaagttctcttaaatcatatggttttttaaggataaaaaaaaatcctggatatctatggctatacttagacatatgtaatatacatatataacacaataacttttggggaacaagtggtttttggttacagagtggtaaagtctgagattttggtgcccttgtcacccaagtagtgtacattgtacccaatatgtagtgttttatccctcacccacctcctactctcccccttagtggtctccaatgtccattataccactctgtatgcatacccatggcttagctaccacttaaaagtgagaatatatgatatttggttttccattcctgagttacttcacttagaataatggcctccagctccagttggagttgctgcaaatgacattatttcattctttttagggctgagtagtatgtcatggtgtatgtttaccacatttctttatccactcattggttgaggagcacttaggttggttctgtatctttgtaattgtgaattgtactgcaataaacatatacatgcaggtgtatttttgatacaatgactttttttaatttgagtagttaaccagtagtgggattgatggactgaatgctagatctacttttagttatttcaaaaatctccataatgctttacataaaggatgtactaatttacattcccaccagcaatgtataagcatgcccttttcaccacattcatgccaaaatctgtttctttgttttttttgactttttaataatggctattatgctgggaaaagatggtatctcactgtggttttaatttgcatttctttgatgattagtgacattgagaattttttatatgtttgttggtcatttgtatatcttcttttgagaaatgtctattcatgtaattttttttcactttctgttgggattattttttcttgctgatttgttttccttgttaattctagatattaattatttgctagatgcatactttgtaaacattttcttctattctctgagttatctgtttactgtgatgattatttcttttgctgtgaaggtttttagtttacttatgtcctttttatttatttttgcttttgttgcatttacttttggagtcttagtcataaagttttggcttaggtaaatatccagatgtgtttttcttagtttttttccagaatttttatggttttgggttttatatttaagtctgatccatcttctaatttttgtagatggtgagaaagagtgatccagtttcattcttctacatgtggctgtcttgttttccctgcatcatttattgaatagggtgtcctttcctatttatgtttttgaatgctttgtggaggatcagttggttgtatacatttggctttatttctggtttctctattcctttcctttggtttatttatctacctttataccagtaccatgcatgctgttttgattactaaaaccttgtattataacttgaagtctcttaaaactatgcctctggatttgttctttttgcttagagttgcttttttaattcaagcttatttctggtttcataagaatttagaattgctttctctaattctatgaaaaatgatgtcagtattttgataggaagtgcattgaatctgtagattgcttttagcagtaaggtcattttcacaaatatgattcttcttatccatgagcatgggatgtatttccatttgtttatatcatctctaatttatttcagcagtttttgtagctctccttatggagatctttcacttatttggttaagtgtatttcaattttttttctgctgctattgtaaaagaaattgagttcttgatttgattctcagcttgatcattgttggtgctatgcagtagtactaatttgtgtacattcattttgtaacctaagattttatgaattcattcatcaaatagaagagtcttttggtggaattcttaggcttatctaagtatatgcttaaatcatcagcaaacagagataatttgtcttcctcttttccagcttggatgccctttatttcttcctcttgcttgattgctctgggtaggacttccagtactatgttaagtagaagtggtgaaaatgggcatccttaacttgttctagccctcagtgggaagactttcaacttttccccattcaatatgatgttggccatgggtttgtcatatatagcttttattattttgagatatgtttattctatgtctagtttgtttagggtttttatcataaagcaatgctggattttactgaatgtttttatgcatctattgagatgatcatacgtatttggtttttaattctgtttataaaatacatcacatttattaccttgcgtatgttgagtcatccttgcctccctgggatgagactcacttgattatagtgaattgtctttttgatatgcttttggatttgatttgccagtatctgttaagaatttttgcatatgtctttatcagagatgttcatttgtagttttctttttttatgatatgcctttttctggttttggtatcagggtgatactggcttcatagaatgagttaaggaggattccctttttctcagtcttttagagtagtttcagtaggcttggtaccagttcttctttgaatgtctgatagaatttggctgtgatctgtctgggttttttagtcggcattttttttttcttacttatacaatctcactgcttgttattggtctgtaaggatacctatttcttcctggtttaagctggtagggttgtatgtttcctggaatctatctattttctttacttttatttttatgtgcatagaggttacatagtagtctcaaatgatcttttatatttctgtgatattggttaaaatgtttccattttcatttctaattgagctaatttaaacttctatcttcttaattgttctaactaatgttctaactaattgttagaacaattgttaatcgttctaattgttagaacaattgttaatcgttctaattgttagaacaattgttaattgttctaacaatcttaattcttctaactaatgatctattttatttctattttcaaataaccaaattttgtttcattaaacttttgtatttttatttcaatttcatttagttctgctgtaatctttcttttcttctcctggctttaagtttgatttgttgtttctatagtttcttgaggtatgacattatgttgcgaatttgtaatctttcagacttttttacgtaggtgttcagtgctagaaactttccttttagcattgcttttgctatgtcccagaggttttgataacttgtgtcactataatcatccatttaaagaattttttaatttctttcttcatttcattgttaacccagtaatcattaagaagcagattgttcaatttccaggtaattgtatagttttaagggttccttttggagctcatttctagttttatttcactgtgacctgagaagatactttatataattttgactttttaaaatttattgagatttgtttttgtggcctatcctatggtctgtcttggaggctgttctatgtgttgatgagaagaatgtgaattctgtggtttttgggtacaatgttctgtaaacgtctgttaggtccatttcttctggactgcaacttaagtccagtgtttttttgtttttgttgttgttgacttcctgcttcagtgatctgtctagtgctgtcagtggagtgttagagttcctcactattattgtgttgctgtctattccttttcttaggtctagtagtaattgttttataaatgtaggagctccagtgttatgtgcatacttatgtagaattattatattttgttgaattaattatttaattattatgtaatgactttctttggtttttttttttactattgttgctttaaagtctactttatctgatataactatacctgcttgcttttggtttccatttgcattgaatatctttctccacccccttaccttgagtctatgagaatctttgtatgttaggttctgatgcagctcaacattttgtttcaagatttagcatttcttgtaggactggtctgatagggacagattccctcagcatttgcttgtctgaggaagacattatttctctttcatttatgagactcagttttgctggatacaaaatttttgactaatagttattttgtctaaggatattaaagataagcctaaagatacagtgaacttctggcctgtaagatttctgctgagaagtctgctgttagtctaataggttttcctttataggttacttgttgcttttgtctcactgttcttagaattcatttcttcatgttgactttagatagcttgattactatatggctttgtaatgtcagttttgcagtgaacctccccagagctcattgagtttcttgtatttggacatctaaatatctagcaaggctagcaaagttttcttcaattatgccctcaaataagtattcaaaaagttttgctgtttcttctcccttaggaacagcaattgctatatttggccattttacatagtcacctatttctaagagactttgcttatttctttgaattctttttctggcatttcaaagatttcatcttggttgggatccattgctggggacttagtgtgttctttttgaggtgttatagaaccctattttgtcctattgccggaattatttttctggtttcttctcatttggatagagtatatcttctaattacttttgagactatatcttctaattatttttgaatttattttttgatttgactgtgatttttcacttttttttttcactttgaggatgtgactttaatgtttatagtttattgtaacctaattcagctctgggtgctttcaggggtgaagactgtataagttccctggttatttaaaatgtttgtatgttggctttctcagatgctagttgtggtaacattatgctcagtgtgtgtgtggaggttcactgtttcctgtggggtagcaatggcagaggtctcatgaagcttatctagttcccaagtggtgtgcacttttttgcctttttttttctcccagtgttttctttacctggttgaataattcagatttcaggccagtaggggaggtgtccctgagtgaaaaccagcagattggtaaatgcaatacccaatggtgggaagaagcccaagccttgaccaaggcatctgtgggagctcttagtgaaatgcactgaggtcttttcacggggaagggagggagccacttcagctcccttgccaggcccccaggaaagcaggtcacactcctaaatacagttctagctattcagattagcaggccctttttatttgcaggaattctcatgttccaagtagagagagattgtgattctatgccttatgcaaatctgaatctggaggggactcctcctctggggacgcagttaacttgaagtgttccagaaaggctatctacaggtccactcatgctaaattcccataagagaagcaccagctgtgtctgcagtggtgaatgaggggggaaatctttttcttcaagaccgttctgtagattttcccaagtccagcactgtacctgtgcctctactgaaagaaactttccacaggtgggaagttctggactcaagtcctgccatctagattcttttttccatggggtgtgccactgatgtgcactcccccttatcctaagagtaggagtccctgagggccagactagtatgaatgctgctacttctctggctctagccacctagtgggactgccacactccaggttggtgctggggaatgtctacaaggggtccagtgatgtgacctgttctcaagactctgtagtgagtagcaacaacagctctcatgggggtgacaggagaatgacatagactctgtgagatttcttgattataagtagtcttggtgcattggtttttctgtaatgccacctgtagtagtgatgaactggtcgcatggacagactcaggacctcctagtaagccaaggttatataggcaaaggtgacagcttaggtcacacacaagttttctctttcctgtgcactgttagtgtgcctgcagatgctgtaatggattgtgtcagtaggcctccagccacaaggtggcacttgaaaaagagcaccagctggtagcagtgggatttgtgcttgccttatgttacgcaggggaggtaagctgatgactcaggcaatgggcagggccattgagctctcaaaattttctattctttgtgttaagctaccagggcagatggaggggcaaagccagctgggggctgaatcaggcaagttcacattctagctctcttttgtctgccatgtgtgggcaaaagcactgtccccagtggggatcagatagtggtcctctggctgtaggagtaatgttgcagggagtaccacagctgcctctgctgcagagaagcatctgtatgaggaatagggagcagcaggcagcagttagccccactcagctcccacacacttggcaaagcaggtcttgcacctgcagtgtcccactcgcagcagcttggttccaagcagtcaacactcagaactcaacactgcccaagggcataagacttcccagaagagactgcaaccatggcttccaggtcacgcctctcctagttggcccatgaagcaggggcacccagctcttgcacctatggctgcagcacatttcccatctgccccatggttctgaccaagggggtttgtctccactcgagattatatcacgaatctcagttgagagcttctctcaacctgtgaccactgcctgagttacctggctgacttctgtgaggtcccctgtgagataggatcagggatggctttcctctgtcctgctgggcatgcacactaagcccgtccccatgctgctacttctcatatatgccccactgctcactaaatcagctccagcgctgggtgggattaaggcctttccctgtggcctggattgcttggttccccagtaggagtatatgtcctagaggcagtttatccctatctgacattctagggacttaaagttttcctcctggctcatgattttagacagcaacctgacacttctttcaaaaagtctgtgctttctttcagttttcctgttaattttctgtgttgcttcttggaaaaaatttacagtgtgaatctccacacacaattctgtctttccaaataggagaggcatgctaacaatgactctaatctgccattttgagaaaaaaaaatactggaggtctttatttttttttaatactatagcccattctgagttttcattacaacctccactctagtattgtatctacttttcacaaacccttatctttggtagctggatttaattcattaattttaaaattttgataaaaattatgacataattatattattatgtattttcatttgattatctaggtttatgaaactgactaaactaataattatttgataatatgattatattctgccaattcattctacgtgttccttggatatgttaataaacaatagaaacaagtccaactaaaagacatcacttattctgactcttgttttgaaaaataaaacctgacaaatcaaataaaagtaaatgagttattattcagacatccacttatggtttgggtatatattttgacagtccatgagaaaaattcctccaagggtcttcacctccagacataaaatcactttgttgcttttctaaaagctatttttaaaaacaccaacatctttttaaattctcccatctataagttggcaaaaatatctgttgaggtttgtaagcaacattaacattttaaataataaatgtaatatttagggacaatttaatttagtgactcaaggcatctaatatttggtatcagtatacgaatattaagaaacatttagcccttttatttatagtattttttatagtaaaacaatttctactttctattatgcttcttgttctgtgatagtttactatttctgaaactttattttttacaaaatttcaagttgagtctaaaaaaattatattttgttgttttgaaaaatacgtagcctaaaactgtacatgctaacagttgagttttatcagtgttatttttactaaacctaatcactataaaatagctatatcttgtgtatgttaaaaatgtgaaataagatgagaatgtatttgctattctattaattaaattatatgaattagtagcaactattaagatgctttgaatattcccttaggtggatgagaacatgtgagcaagtactagcacagtggtagatgctttgtaaattgctcttactttcctaatgattgacaggctaatagctaaataactaagataatataagcactttcttagaatttagagatccacttaaaagacaggttttcattaggaatttctgtactttatttcacatttccataaaaaaattcctcattgcaagaaccactgcacctattatatgaaaaaactcaagagaaaacaatcaggtgaccattacctctaaaacacctgatttgattcagttatcctataggaatcaagtatcaggctttacaagatcctcttttttcaatgttgttttactgcctaaaacaatgtttaagatgactaattcacgtttctttttgtgacttatttttacttgatctaatttctaaagtgatctttatgaggtgtcttgcctaaaaatttgcctatacttataaatgcattttcacttactacaatctcattttttactgtactgtagatgtacagttagttgaatgcatacataatacttttgagaatatatgaggttttacataagaagaatcatattgaagtggttatctagcatatctaaagaggaaacaacagagaagcaagctggaaacaatatgtagacatcagtaattattttaatttcacaagacaaacatttatcaatcctgtattcaaaacctacatatatgctacttaggatgcagaaatagctatgtacattcattgccaccaaggcatttatgatccaattgaagggcaaatacaaacacaatgaagtttctttgtgtagcaattacacaaataaaacttcataagcttgccaagaaaagcaagaacgaagaaaggaaagaaagaaggaagaaaaacaaatggcaaaacagagcaatatttaaatgtggttatgattcagccaaccattacatttaatgataatgtgcctgtttgggaaataaaatagaagaattaactgaatgccaaggggagggggaaggaacaaatgaaaaaatcaaaacaaaataaaactgtgaaagataattaatgggaatagaaaaaattatgtacaaaaagcattttatttggagagtaatttagatctttaggaatatattggctatattcaagttcctatacttaagtgctatacaataataattaaaggtaccagatttagtaaagggattttgcaccatgaatttttttttcctgtaaagatacaaatatatctccttagtagaacagataacctcacagatttatgacactgttatatatcaatctatatttatttatttaaccaagcaatcttaatgttattttgctaaattgcttctaaatgtcccagtttctcagattccctttgtgtcatttaaaacatctatttgttatttattaattcaagttaatatctttaaaacctattcattttatatttgtctgaaagctatgattttaagcttctaaaaattatattttaatagaaatcagggactagttacctttaatctgggggagatactacatattttaaagcctgaagtcaatgtctagacaaaagtttctgcttaacatcaaagggtatgcaacatttgctgtggctctcaaatattaagaaaggaaaacacaactgggaatttgtcactagcactttattctttactcaggattgaagtagaattttttgacgccaatatttttcagaaactttaaacattagaaataaaataaaaactagcccaattccaatattccccatggatttcctagcagaagaaatgtgaaactcttatggagaaataatccaatattgcaaacacaaggatttgccactacagaaactaacaagttaaattgaaaactatattaaaaataaattcacaaacaaaaattacaaaatacacaatgaaaaatgatatacatgccaggcgcggtggctcacgcccgtaatcccaacaatttcagaggctgaggcgggtggatcacctgaggtcaggagttcaggaccagccaggccaacatggcaaaaccccgtctctactaaaaatacaaaaaattagccaggcatggtggcaggcgcctataatcccagatatttgggaggctgaaataggagaattgcttgaacctgggaggcggaagttgcagcaagctgatattgcaccattgcaacccagcttgggcaacaaagtgagactctgtctcaaaaaaaaaaaacaaaaaaccagcaataagagtcagcagatgtaaaacagcagaattaaaagtatgtgtaaaaatagatgaataatttgaaaaaaattataaaattaataatatgtaatgaacatacataaacactaaagacatttaaaaagaaatgaagagcagatttggcaaaggatatccaaaaataaaaatatagtaattgaatttaaaaacctatgagatatggatgattaaaattaatataataaatatatatcacagagaaataaagttatcaatatagagcaagatggacaaaaattattattatattagatactttgggtgcatttaagatggtattgaggcaatatctagaggtaataactggaaattttctataagtcattaaagaaaaaaaattttcacattcaggaattggacaagttctgaacagaattgataaaaataaatccaaactagaaagaacactgatttggtgaatattttaaaaagaagctagttcactgaaaaactaatacaataatgcaatggcataccaagttccaaatgcaaaatatacagtgcaagatagaatactatacacagtgctgagactttttgggtctacaaaattttaagaaagcgcactcatggattcattgaacaaccctttttaaagtaacaaagaaagaaaaaagaaaacactaaaaaagacaagtgtgagaagcaagtggcaactgtaaacctgttaaatgtaagggtaaatctaaataagcattaattatttgaaaatgtgaggccaggagtccagtccaacctgggtaacaaagtgaggcatgagttacaattaaaatactagaaaagtattgaccatttcaattaaatgttcctttcaaatcactaattattttcatgttccaaaatttaaaggttaattttttattctcattttattgatctatcagtagtctctttttctttaattaaaaaacaaacaaacaaaaacacataaacaaacaaacaaaaaaacccagctttttttctttggcttccagaacacgtcctcttggctttcttcttatgtctttgtatgctatttcttagtctttggaacacttctgtgtccacccccactcccttgatgagttctcacagagccatggtttacaatattgtttatgctaagaacttgcaaatttgtacctctacctcttacttctcttctaaatgccaggctcttacatccaacttcttatgctgtcttcttttgagaagctaataaacatctcaactttgaaatgcacattctcacctacgaccatttgtctcaaagcaaaaatcttagagtcaatcctacttattttctttgtcaagaattgcacatcccacctttcagcgagtctttctgcttgctctacattcagaatctatccaaagttagtcactctcttagtctctcccagaaacagatcccagtaaaaacattcaatcagaagtaatttgggatgtagagaaaaactatattctttttcttccctcagccttttgatgtgtttatttcaatgctatttttacaatgttacttactgaatacattaattaaaattgtaatctgccactattactgtgtatcctgccttactttattttcttcacaaaatatataacttttcaacacctgtctatattttatttcttttgtgtcatcctacatctcactgtaatctttacaaaggcaaggatttttttctttaatatcctaaatgtagatgtttgtctctagtagattcaatggtgcctcccaaaatatgataaatatgcacatatctttccatatgctagcccacagaaactgtagatgtgacctaatttttttgtatatattaataaggatcttgagatgacgtcatactggatgatcctagtgcaccctaaatccaataagtgttcttatgaaagacagaagaggagaagatacaggaaatagaagaaggctacttgaggatggaagcagagattggagttatgcagctacaaaccaaagaatgccttgagccaccagcagctgaaagaggtaaagtaggatccacccataaacacttgagaaggaaagtgggcctatctatacctttatttcagatttctgccctacagaactgtaagagaatatatttcttttgctttaaacatttaggtttgtggtaatttgtcataacagatccagcaaactcatatactggcactgagcagatattcaataagaattgattatgaattatagtcattatgatagtgcggcattgactcagagatgaacaatttgttcactggactatagcaggaaattcaaaaattcatggtagactttcgatattttacatatgaattgtcgtatcacccagaaaaatgaataactattcataaaatagcagtgatacatttgattaacatatagaaaaattgtaaattgtattctatcatcacattaacttcaaatgtgaaagacatcttgtatcacttttaaagaaaatataaaatatattttatttagtaaaattgaatttgtagaacgatgactttttttttactttactgcttaatacttgagaaattctcctctttgatgaggctattagaaaacaggaactctaacaattatatagtgggaagataaattcatacaacgactttggaaagctacttgacaatgtaaggatgaaagtgcccaaagttgtaaaatttccctgctctatgtgtatcctatgaaaattctaatatatataaacaacaaaacaataagtatttattgtagctttgtttttaacatttacaatggtaaatataaaaatgccaatatttcctgatatgaaaattgatagctttatattatatatataatgaaatcccatatagaaattaaacaaaaacagatacccaagtatcagctggaatggttctcaaaaatatcatagtgagattataaagcatgtgttgaaataatacagagaaaacaataacatcttatttaaatttgaagatacaaacactaccatatacggtataaaatattctatacacagacctgtacttaaaaatagagaaatatacaaggggatgctaaacaattttagcctgtagttatcccttgtagaatttcttataatcttgtttctggttatgttgctgtatcaattatttttcagttttgggtatgtgtgaaatatttcataaaaggaagttggacgttttaataatacattgactttaagaggaggaagaataggtgattggggtattttgttatataccaacacatgactgaaataatcatctattctaattctgttcagttcagtggaaagtctttgaagcttttttaacagagttgcactttgtcatatctttgagaacattgtgttagattaagtggaacaggaatgcttagagggaaggagattaaaataatgtgttgtatggatatttgaggtgacatacaatagaactggaaaataaagaaacttcatgaaaaatagtataaaaagagacataaatgacttaccaattgactgctgtgtttgatagatgggaattgtagtcgtaacattggatgaaataggaaagacagactagtagagctctttggaggcaaattctataagttctttttacattttgagtgaaagttttcacttttaaatgaaatgcatatggataaaaaataaaggtaaatatagttattatgaaattgtcaagataaaatgagagttgatgcataaaaatgaatagactggaaaaagggaactttttaaatataaaaaaaattgcctcttttctgacagtattctttcttcttaaacttcatgattgttcctggaaattaaagtgaaaaaaaactatcataaaactatgactctatcatactgtaacacttcagggcccatattattatacctcctctgtccatctcgcatgactgtttaaaatggttctgtttgatacactgacactcaatttctttttatatggaatgtaatttgggagattctctaaacaatctgtataatggcagacatggagtacaactgaaattagaaatattctgttgtagtttccattctttcttaaaggttttaacattttgttatgaacatgacaagccttatttttttttccacacatagaaggaacacgaattataaatagaacaaaacactgtgaaatactgcaaatgtggaataattatttgatctcatgcacacacctcggtaatttaaattaaattctataagtaaatgactaaatattttaaaattaactactttaaattaagatgtatttagaaataattttaatgttattgaaatttttttaaaaaaactattgtaatataagaaatcatgacataatgcaaatactacatattttcagaaaatttggtaataaatatcatctcccaaaaaaccatcttagtcattgcataaaattctacaaatgatatctgattttaatttagaggaaagtacatgaactgaaagtcccgactgaataaatgcttaaaaaaggatgatttaaaaaaatttaaaggtaacatttattaattaaaataattctgatagaaaatcctaacaatgtacattattgtctagatttataattccgtaaattaaatatacatccccctgcaagtggcaatacttcaaaaattaattctagtttacaatttagtataaaataatgtattagaagtgtccctgaaagatggagtttaatggagaaaaatgaggaatattatgagtatcaggacatggagaagagtaaaaagtcaatattgtgggacaaattaaatgacattaaaaaatcaccttttttcatttgatataatgtaatggttataaaatatctcctcagagttcttcaactgtcatttcattgagatgtggggactggggtctctgaccttgaatctgggaggacttttaacttctttgactaagagaatacaaaaaaaatcaatgctgtgtaacttttgagacctggcctaaatcgacaatctgacttctgctcactttttttcagactcctccatctcaggagggccccagtattgccaggctgggagaaacccaaaccatgaggatagaccacgaataggagttctggttgacaatcccagttcattcctagcttcaaatacacaaggccaagtgccagatatgggcataaaaagcaattttggaagtggacactccagtccaagctgtcctagccctcagctatttgagttgcatccagacatgtaaatcttcccagctgaggcctcatcattgaggtgcagaaaaggggcatgcccactgtgcctgtttctaaattcctgacccacagaacctgtgagcataatacaagtttactattttataccagtaagtttggggtatagtattatgcaacaatacaacctgatgcacaaaaaatctcttctttgttacataaactctatataaactggcatatgcttagttcttaaacctctctccaatctccttctctttccccatactcaaactaatctttttttttctgctccttcaacaaaccagcacttgtatttacacattagataaattgcaccattaacttaaaaaacacaatttccaagatttttacaaaactgtgtcttatagtttaaagtatctcagcctttaagtatcacttgttagataacatttagttgccaatctttataattgctttctcttactctactccttagcttacagtcctttctgccatatttatcgtatttgtataacagatcaaaatctgtggttatctatttatttacctaattttcagctctctccacttattatcatataagttacaaacatttcaggtcatatcttcagtttaccacactataccagtagcttaaatatcacattacccatactagccactcaaaaatatttattatggaattaatggaactctaaatttaatctggtctccaaactaaatatatggcttaagtatcaatataggtttcaggtagatagggtttagctataaggaatacagggtgcaactaaaagcagttttcacaggcaagatgtttacttacttctacaaaagaaagtacaagccaggacaggataagaagagcagcctcacagggacgctgaagatttgttatacacatgcagggacattaatagcatttccttagaaagaggtatgatataagatagcttgatgcctgtagcaccctgagacatgattgctcatattgcagccaagaaaaataggaaaggctgaagcagcaaagggcaaaggggcaaaaggccaaagccatgcaggccaagtttgtgcttttttaaaggctttcttaggaacctatcttatgatatccatttcaatgtcacaaaattcacatggccacaccaagaaacatggatattttactttccaaataaaaaactaggcaagagaagtttacatttgcatagcctatcaatagtgtctgccaagatatttccattttttagtgtatcagaaaattgggcacacatgactaacgtacttttttcattttaaatagaaacaaatgtgtgtgcatatatatatataaaatatacatatttatatgtgtgtaaatatatgtgcatgtgtgtgtgtgtgtgtatgtaaaaccaatcaacttctgctgaaaaacttctgtaaaactcattttttttttccagtatgtttcctctgaagacaatcttcacatctagggaatattaatggtaataataacagcattgatttattgagagttttcctatgtaacaattactatacaagtatgccatttaatctatttctctagtttcaatattaatattggtacttaataaacgagtaaactgaaaataataagtttaaaatcttttttcacagctagtcagcaatacaactgggatttgatatcagattcatacgattccgaagaccctgaccaccaaatgcaaaaggtacatggcaacagctgattgcaatgagagaaaaacaactaataaggcaacaagcaggatactaagatattttccaaaatgaatagcactgattctgtgaggaatgaacattgccaaacaagtgttttgttttgtttttcaactcctctaaaaaaattcacatatatgcatgccactttcctgaaaaatatctgcctcataattgccataagaaacggtatggacaactcttaaacattctgaaagtagtcagggatgggggaaagcatttgctgttttagtctgttcctggtcttataacaaataccacaaactgggtaatttatgattacagaaatgtatttctgaaagttcaggagttgggaagttcaagattatggcaccaacatattcattgtctgatgagggcctgtttcacagatgtcattttgcatgacttaatcacatggtaggaaaagcaaagggacaaaatggacaaatgccatgttgtcacatggcagaagaaatggaagagccaggaagctctcagaagcttccttaattaggatattaatctcattcatgagtgcatagccatcatgacttaattgcctccaaaggccccacttcctcatcactttgaggattaaacttaaacatgaatttggaggaaatatatccaaactctaggactagtttaaatgtagctaaaaaggtttcttcattctgtaatcgttaatatgctaatatttttgtaaatatccaagaggaagctaaagcatataatattccaaaatttatttctgtttgtggatattatgttttcctctcattctatcttaagaaattagtgtcctcaagaaacactatataggataattgtctttcaagttcatcaactaccagttcttgattcttcagtagctaatcctagatagtaatacttaacagattataaaaacttgggtgctgctatataaatgcgctgaaactcccagggaaccaaacataaggacttaaagagagatgtaactagggatcataatcatgaatttcagctgcttctctatctttgtcagtgagcaaatgaccatacaaaataaggtattcaattattaattctgtgcccatatcccggaattttgcccaatatatttgtaagtttagataaataaggcactaatgccagggatatgtagcattagttctgggtttataaagggatattcacaacctcttgccatccacagaatttatcagcccaaagtaaactatactcgttggttaagggcaacctgagacatgtttaaaactgaggtggactgaagagtcaactaattgcaggaatcttttatttggttgaaatgttcaaacaagtcccactctgaattctattagaagtccatcattggcttctctctctttctcactgtcttaaatcatgtattttataacactatgaagaatgaagttcaaaagaataagctaaatttaattaattaaattatttatttatttattttgagacagagtctcactctgtcacccaggccagagttcagttgcacgatcttggctcagtgcatccttcacctcctgggctcaagagatcctcctgaagcagggcatttccctgaccccttcatgggactcgtgacaggggtgccccatttactcagcccactgctctcaactcctcaagggagggagtgcgcaattgaacaaggcaggaactggagtacacgagtgctggaaccagtggcctctttggtgccagaaggagtgaactcacccactctgacctgctgtgttccacctcttgcaggagagagcatgcaggtgagcaggtacaggagccaggaagagagctttggggtgttggcaggagcaaactccatgtgggccccatagcagcccctggggttaggggggtgcctgtgattcctgaagccccagtgggcatattacagtgctcctttagctctgccgtcttcagacagctgaagtgttagcagctcagcatgcctttttgtatccacactcactcctgagctcttgtttggcatccaggaaaaaatcagctcacagaaacgaattgaaggatggtaaatgcagaggattttattgccaaggaaagtggctctcagcaggaagggcagctgggaaggagatgtagcaggaaggtttctggctggactcttctccaaagttgcactgtcaagctgtctctctgaaatcaagctgcttctctccaacgtccaaccgtagtctctgatgcccagctgctgcttctcttttgatgttcagctgcttctcttttttgctagctgagtctggggtttttatgggcacaggatgggggacaggggaggtcatgggtaattttgtaaaaggcaacatttgagtgggaaaacaggaatgtatgttctcactttgggctttggttccaggcttgagggtggagccgttgccagggacctgccctcttttgcccagaatttccctgcctcccttccctttcactcccaccccatcactcccacctcaacatcctgagtagctgggattataggcgcacaccaccgcatctgattaatatttaaattttttgtagagacagggttttgtcatgttgcccaggccggtctcaaaccctgggctcaagtgatttgcccacctcagcctcccaaagttctgggattacaggtgtgagccagtgtgcctggccctaaataatatttatatgggcattttgtaattattattttttaataatataaatgtttcctttttaatatgaatttttcaagagttttataattgactgattattcattaaaatttaatgaaggacaggaattggctatttttctgaatgacaaaaattaggaaatttttagagagatgatgaatttatcctagaatatatggaaagagtaaatcttgttatatagaacaagcaactttccaatccgaaggatcttagaataataaaaattttttttcttataattgttttcttataattgtttcaaagtaatactttagaccaaaaattgtatatctcagtaggtggcctatatgataattaaaaaattaaaagctaagttaattaaatttttaattaatttaatttttattaattttaattatcaatcttcattgaagaattttgtccaaaaaatgtggacaatatgtgtcataaggattaatcaccataaaatagtccccaaaggaaattaaaggactgattagatagtactaaaataacaatcatacaaagtagaaagtggtgttataagagaaatgtagataaaatattgtaagaaactaaagtaggaagataatgttttgagttgtgggagatcagggaaggttttttggaaaaagtaacgtttaagctagatcttagagagacatgacttaatagaaaagtaggcaaaaaaatatgaataaccctttcagattacaggcaatacaaattatgataaatataaaaaaattcttacttcactagtaatcaagtaattgaattaaacaattggataccattttttcttcagcagactggcaaaacataagatgttaacaagggttttgagggtacagggaagagggtaggctcaaactatgctggtatcaatgtataaccaagatctcctttggagtacaattgttatatagtctacattctgtaaaaactaaacacatatgtttgcctttccacttttggaaatacatggtagataatcatgcaagaatgtcaattgcagtattgtgttgtaatttttaaaaatactctagatattcatcaatatataactacaaataaaaatagttggactatcatgcagactacaatgcctctattgtggcataatagttaataatacaatctctgagagcagaatatctggatttgaataatttgctctccctctaaatgaccttgagcaaagtacttacaatctttttctctcttccataaaatggagataacagcattgccaatttattagcttgtcatgatgattaaatgagataatccatatatcacaccaagtacccactacgtaataagcaactaattaaatttgactaatattaataatttcattattattcatcttaatatcatggcatgacttctaaggtatattattaaatagaaaaagataagttttaaactgagccatagtttagaacttgacttaaagcagactcacaaagcaaatgctcatatctaggacaggtaaatctacacgtgtttatacacacattcactgtatttggggaaaatacacaccaaactggaaacactggttgtctctgaagaagagacagggctttggcaatattcaaattaggctttaactgtttctgaaagtttcagttctctataaggagaaggtattacttatgtaatttttaaaaattacatattaagtactaaatgactgaagcttcttagaattgatgggtgcaggcatcacatgggcagcaaggcattcacataatggagaatcatggtctcctgtagatgtctaggagtgataaaattaactaccttttaggtggtgtagtttcctggttgagctgataattattaagttaatgattagtaggttatttctcaacaccgaagagattattagtgtttcaaagttttcactgtaattcatctgtaaaaccattcaacctacctccagtacacctcagtaatctggtgacaagagagtattcttgctcactttatttactcttcagtgatctaatgccaataatgccagcctatagaaacaacagccaattataacaaaaagcacattagaaagtcaaatatagctgggtaatagacataaaaataccttattaacatttttataacactctgaactgaaataaacagaccactctcgattttagcatctggttccaaacaattcttgtttgggtgataactttttaaaaacaaatgttgggcatctttcatcgacttttcatcaagtaacagctgttcctttagagcaaaatgtatgcatgttggaagtgtgactgatgctcacttctgttttgttctgtgtgagaaagctttatgttgggtgcaattcagaaaacaaatggtttcaaatcttttgaatagatgccatagcacagtttaaatgcagcttcttgtgatttttagaataatttcagccacaatttttacattcaatttataactatactaagacattctccttcagaacaaaggcatttctgttttcatgtgctcttgggcatcttcgggtcattcattatatcaatcatttatcttcgtaaagcgtttggctatgaacaattacttactacaccaaagcatgaaagaaatagatatagctcatctgctcttgaatgcatttctacagattcccttaggataattcctgtttcaacttaagctattaaattttttgctgcattcaaatcacctcatctgctgaaacatgtggagacaaataaccacagacgtttgcatgaaggttcaggtgtatttaagggcagcttaattataagacactatgaaattctcctaattaatttggagctaaatattctacatcaaatattttacaaaacttaaagaaatatttacttttcacatgattacgattttgatactaggttaaaaatgacttatactggcattttttaaacagtttaagacaaataatgtttttgatactgtttattataacatatgaaaagtctttatgcagatatactctattttatcgtctgttcatttcatgttgcatttgcatgcactcctgaattacttgttactaaaacatacagaacagacagaaagttaaaattggttaatttctatctaatctggataagataaacacaatgagtgaaataaataattatgtcaaataacaaaaacctcatgcatagaaacttcaacatttctgaataacaaaaagtataacattatgtagggcaatgttccacttttgtatcaactagaaataagccctgaatctgaatgatgaaattttaatagtaactgttgaccacagggcagagtttactctcttggtcagatgcttttgtgaatgacacaaactgtgtgtccagatcacttttccctataatcacttcaaattacttgactttttgatctcttccttttttctgtctcttttttgtccacaacagatattccaaatatccaccgagttttcaaatactccagtccatatttggtcttcccattcctagcagaagtactttgtcttctacttcccagaataatgttaattctcttattttagacttgcttgctttaatttgtatttattcttggctttttttctttccatctcacaggataagagggcatctcttcttccatattcataaatacgttgccaacaggaatttgttgttatttacactttcttctcctagacattttaattttacttaccttccctgagcacatggcaaagtcaaaacacaagcagaatcttacttatgaatagaggcagatttattaagccaggggtaggcaaactatagccaatgagccaaagccaggctgccacgggtttttataaataaaattttataggaactcagccacagacattcctttacatattgcctacagctgcttaagcactacaaaggcaaagttgcatatttacaacacaaataatatggcctgcaagcctaaagtatctactatcgtgccctttatagaaaatgtttatcagcttttgttctcttatcctaagttatgaggcttacatttccggccacctcatttgcatttgagtttccagttttgagtttgtagttttgcattcttgcttaaagagccccaaaccctgaccgccaaattgaatgtgctgtagatcccacaaaatatggatccaatcaagctgatgccatgtcattatctgtagcttttattctttgccatcacacaccttccttgaacagttaggcttctgcaaaaaatcttaaataatcactgatatgggttggttctgtgtcttcacccaaatctcatcttgtagctcccataatttccacgtgttatgggaaggatccagtgggagatgtctgaatcatgagggcacgtatgtcccatgctgttcccatgatagtgaatggatctcacgagatctgatggtgttaaaaatgggagtttctccacacaatctcttttttgcctgctgccatccatgtaagatgtagcttactccttgccttccaccacgattatgatgcctctccagccatgtggaactgtaagtccaacaaaccactttctttcgtaaattgcccagttgcaggtatgtttttatcagcagcatgaaaatgaactaatacagtaaattgttaccagtagagtggggtgctggtggaaacatatccaaaaatatggaaacgacattggaactgtgtaacaagcagaggttggaacagtttggaggactcagaagaagacaggaaaatgtggccaagtttggaacttcctagagacttgctgaatggctttgaacaaaatgctgacagtgatatggacaatgaaatccaggctgaagtggtctcagctggtgataaggaacttgttgggaaccggagtaaaggtgaatcttgctacattttagcaaagacactggtggcattttgcctggccctatagatttgtagaactttgaacttgagagagatgatttagggtatctggcagaagaaatttctaagcaggaaagcacttaaaatgtgaattcggtgctgttgagggcgttcagttttataagggaagcagagcataaaaatttggaaaatttgcagcctgacaatgcaatagaaaagaaaatcccattttctgaggagaaatccaagccagctatggacatttgcataagataatggggaaaatgtctccaggacatgtcaaaggtctttacctcagcctctcccatcacaggcacagagacctaggaggaagaagtggttttgtgggctgggcccagggttcctttgctgtgtgcagcctagggacttcatcccctgcatcacagcaactctagctatggctgaaaggggacaacatagagctcaggctatggcttcagagggtgcaagccccaagctttggcatctcccatgtggtgttgagcctacaagtgcacagaagtcaagaattgaggtttgggaacctctgcctagatttcagaagatgtatggaaacgcctgaatgccgaggcaggagtttgccacataggtggggtcctcatggagaacctctgctagggcagtgcagaaggaaaatgtggggagggagcccccacacagaatccctactggggcaccacctagtggagctgtgagaagagggccaccgtcttccagaccccagaagtgtagatccactgacagcttgcactgtgtgcgtggaaaagctgcagacacttaacaccagcccatgaaggcagccaggagggagactgtaccctgcagagccagaggggtggaactgcccaagaccatgggtatccacctcttgcctcagcgtgacctagatgtgagacatggagtcaaaggagctttagatttgactgcccttctggatttcagaattgcatggggcttgtagcctctttgttttggccaatttctcccatttgcaatggctgcgtttacccaatccctgtacccctataaccccattgtatctaggaagtaactaacttgattttgattttgcagggtcataggtggaagggacttgccttgtctcagatgaaactttggactgtggacttttgagttaatgctaaaaagagttgacattttgggggactgttgggaaggcatgactggttttgaaacatgcagatatgagatttgggaggggctggagtgaaatgatatggtttggctctgtgtccccatccaaatctcatcttctagctcccataatttctgtatgtagtgggagggacctgatgggagaagactgaatcatgggggcaggtctttcccatgctgttctcataatagtgaatgggtctcacaagatctagtggtgttaaaaacaggattttctctgcacaagctctttttttgcctgctgccacccacataagatgtgtcttgctcctttttgccatgattgtgagtcctccccagccatgtggaactgtatgtccaataaacctttttcttttgtaagttgtccagtcgtgggtatgtctttatcagcagtgttaaaatggactaatacaatcactctatcaaatgagataatatttattcctttaccactgacaactctctctcggctcttctattcaatcatgttactgatagacgctttgctttttgtttttgttgtttaacctgattgttatagcttattttatgaatttctgttcttcttttaattttacaacaattttactatttctccttacatgtttataagtcatatggagactccttctcatctaccctgaccccagaatattaaaacttttcagagtttcaggattaattccattatatggacatgattccttgagataggaaaaactgattggattgtgacattagacttatcagaatctaagatcttacaaaatataaagctttactagtaatttcacgaactcaggtaatcattaggcataggcaaatcagagaattatttagatctcttaatctgattctttagatccttggttctgtcattagatactcccttgcccaggcagatagatgagacttctagagaggtatgcagacaatttatttacatggagatacctgtctcaattatcaaatatcttaatttttatgcagatagttacatatgtggtatatgtgacattttccagggagccccataaatccacaaccttctactttgttaaccataagcaattctaaacgaccaagtacattctgctaaaagcatttctgtgatagataatcactctcctgccagcaaaaaaacaaattgtttgtcaggagctgtcattagtatgtttatataagcaaaatgggcttccttccttctgtggatcctggcagggcatctcagtaatcagaaagaatcaaagaccctttccttcccaatctgctctggccttggtcaacatcttagtgccaaatattgctggtgtattatcattattgtcttacaccattttctgcagtgtttcacttaagccaactaatactctgaccttgatttgaaccatccaacagagagtaggaattccctccacaaagcatgttactcattaacatcttcctttacaagtctcttgatgttcattcacaaactcaattacctttttcctccatcaacctcaattatttgcatcattttccatgggcctatgggagtatttaattgaatacatattttttcttctcaaatcaaattttctgaaaaaaatttgtttctatgaactgtattttaggtatattccaggttggtacaaacactaattttcaggggtcattatgtcaaagagcccatccacaccccatggcctacatatgtcaaaggattgttctttattcatccactttctatgaattccacacacgggagataaacttctttttcatccatattaccagggttgtcagggagcaacactgaaggtcacagtgttcagtgaaaccttgccataacttagactaaacacgtttttcccataattttacttcttcaaattctttctttttctttctttctctttctttctttctttctttctttttctttctttctttctctttctttctctctttctccttttctttctctctctctctctctctctttttctttttctttcttttttttttttttgacagggtttcactcttgtcacctggctggagtgcagtggcacaatctcggctcactgcaaccttcacctcacaggttcaagcaattctcctgccttagcctcccgagtagctgggattacaagcacctgccaccatgcctggctaattttgtatttttagtagagacggggtttcgccatattgaccaggcttgtcttgaactcctgacctcaggtgatccacactcctcagcctacctaagtgctgggattttacaagtgtgagccactgcgcccgacgttgagcttgtttctttatgaattcctgcaactcaacattaaagacataatatcccatagtgattaatatatccaatagtccttcctgactaaaggtacaaagttaatcctagtgttgttaataagcatggaagtcattatttattcagtgtcttcggttcaagcattgtcttaaaccaaactgattttctactacaactgagtcctctaaaaacagcttcctctagtgtccctatttgaagtagcaagtcatttttatcataatgatgggcctcctagaacactacttcaattagatttaatatcacatgaccaaatcctgtaattctttcaaaatgcctggcaaaggggccagtgctgcttaacttgccactcatgtagttcatattatgtgctaattaaatgtgtctagtttgaaagcattgtctacacctacaaataatgtgcttcatgaaattctcaattaggtatatcctagcaccagataccgttttatctggctgtgccataggcttcccttaaatgtcctctacttacctcttgagggagttatttataattttaaagcattaaagcaaacataaaatcacattctctgaggctttctaggttctagttttatattatttaaattaattccatttacattcacactgatatgttcaaagcaacagaccagatcaagctgtgacataccagacaggcagccactatctgctttctatcataaccagggagctgtcttagcaatgtatcattttgatttatggccatatagggtgcagaaattctattctacagcatcctctgctctgtacaattcattggtagtttctctggaaaaaaataatctagaatggtaaacaaagcctagaaactgagtgataactgtagtcaactacacacaagctgagttgtcagggggcactttgtcatctgttttattcaaattatacaggtagaacatccaaatcagtaggagtccaattttccttttctgcagtaagcaggccaagagattttcaccaacaaagcccatttgtttggatgacaatagcaaaagatagttaagtatgatatcctcactctgagctgtttgcatgaaaatattgtagtggcttccctccacggtaatgtaatctacttataaacacctttcccatctgctatgattttaccctatttccaaatgcttcctcccaatatcaggctgtataactcatcatgcataatgtttgcccgcacaatcaataacaagaaccttactagcacacccaaacaaatgtttgggttttatttgtttgtttgtttaacttttattttaagttcatgggtacatgtgcagatttgttacacaggtaaacttgtgtcatggggtttgttgtcaaacaaatgttataagtgacagacaaaggacctcagaagtctctcctctgcttgataatggagctaccttcacctttagccctaattggttacataggaaggaacttttgatccaccacaaattacctttcagaaaaggcacagtcaaattaaatgacacaaatatcatgtcttgggtattgtataatcttcctctggtgcaagtaaatttaaaactgggtttgagaccgccattagaggccaaataaaagtattagaggtgggaaagatataaagttatatattattgcattctccttcactccctcattattacctcttgatattagtaaggcacagtggattttgttatttatttctcatattagtctcaggacgcaatggtttcactaaatgaacccttaataatttttgagcaaggggccttgcttttcatttttcactgggttacagaagttatgtagctggtccttcctgttgacattggctgtgtcattcagtgcaacagcatgtgtctttcaaatggattatagcaaacagctgccacaggcatattttgagtcaaaatcctaaggagtctaaattggtggtctcatttaacttttcctaaagggctctagtttgggtatgccctaatatcatctgaccagttggatgggatcataagggcctaatgttattgcctgtgctaccacctaccacgatacttttcatgcttatttctgttcagtacctgcagtgagttaagtagtgctcttctgaaattattattcattcagaatctcagaaggtgaccttctttagaaatttgcacatacaattagttaagatgagctcctactagattaaggagggtcctaattccaatgactggaggtgtttttataagaagagaggacacatggagaagagattgaaaatgaaagcagaaattggagtaataaatctataagtaataaagctccaaaaatttgtaggagagagtagaacctaggcaggggcaagaaaagatttttttctgtggcttttcaaggaagcgtgaccctattgactccttggcttcagacttctagcctccagaactgtgaaataataaatttcagttgttttaagctacccagtctgtggtaatttgttccagcagccctaggaaagtactacaatgctgtattcacgttctgaactctttccagttattttgtgagtatgggtagacaagattcttagaacagtcttgacagtctctgagtttattgcttattggtgggtcctatgaaatataaattacttctcacagtttaaggaatgtcctaagttgatctgcactaatttataggatttagttggagtttaaggaatgtcctaagttgatctgtactaatttccaggaattaatttgcaccttgggctgtgccttaaattctagctggatttatcagccagcttctatttgtaatacaggtgactatggtccttaactcctctcctaatttttgctctgagaagaaaattatcatcataccatgaaagtagtagatgaactctatcttttaggttattctttaccagattatggaaatgtgataatgaatttttttaaaatccatgataagacagtaaacatatacttgtttctattctgcaaagcttaaaattttcctacttgaaatttaaaaaaaaaaactcttaggaggcccctgagattggtttaatgctctgttgtagctatctggaaattcttaataatttttgagtaagtatccatgcattttcattttatactcagctctatgaattatgtagttaatcttgataacatatcagagcctcttgtctactttattttctgtacattcttcatcctatcaggtacagatgaagcacgcaaatgaaccaccttgatactctactgtaaatgtccaggggctacctacttattgaccagttagaactacaaaaaggaagttaatgtggggaggggaacttccttctgaaccattttcttaattacaacagtagtctcttattgcgcccttggaattctgcattgcttaatatttactactgtggagagcttgagcaattccaaaggatcccatttggcagagctgattaaaatttggtgaagagtgagctcagtcttcatcctctgtggaaacacaaagacgacaatgtcccattcatactgaatgacaattgcaattttgtatttatgtaaaggtagcacaagcaggtaatattctctccaaccacacatttcaacctgtaacttcatctttaccttggtttcctccctgatgttctcttcatgcactccagatttcacttagagcatgtatgagactctttcctaccttccataaggcctactgtaaattctgctctacatcctaccaatgataagaaactttgaataccaccccaggtaactttgttcaaattatatatatggcctcagatccatgactggggctggaatgaacagacctcagttctttatttaattgttttcagattctacggctttaattaaggcagtaaactcagccccctgttcaagtatgttctgttctatatcactatcctcataattggatttgaactctttcagccacaataaataaagcaaattttctatgattctttaagggattggtgggggctacagtactcctctcctctgattcaaaagttgataatgtgcttttattttcttattaaaaattctatcaaggcttactttttaaatcctatttatattttcttcaaaagtaaattaattcaagtgagctgcctttctattttctcttctgatttttaatttctccctgttgtgcacatgatataaatgctttttctccgtataatcccatgtatagtaactaaacctgtatgtttgttactgttctctgaatatatatatttggccctcaaggttatataagtcttgtaagacagagaatcattagcttatcccattcactctatctcttattatttgtatcaatagcattaactaaggtgttttctctctggaaaatataaagcctgtcaacatttacacttgtatcattcctatcatgtgaaaaggagaatccaattggcaatttggagaggagtagtagcagttacccttctcagtataggactgacaaatctcaccttaacaactgcagccgatatgctgtcacagtatttggaagtgttttctcaaaagtttacagccatttaatgattagccatgaccatgaatagtcctttgcatcagataataatagaattgcaacatgtcctccatcattaatttgaagaatccatgccaatgttaattcaccagtcttctgttagtgaatactctgttctttaataaaatatagttttcactcatcacctgtccttggactccggttacataaatagtttgtccaataatcaatattttgagtcatttctaaggatacatgaaatttctccaagaaaccagggagggataagaaggttttccagtgaataaaatgtaatctcgcagctttttctcccactatcatctcctcctattaaaaactaacctattaaaaggttagcttttacaggtatgctagcaggagtcagtcaatgggatttgcacccaatttccctttgtccatgtactccctagacccgtactcccagactgtagtctatggcccccagatttcaatggtaagacttatttcccttaacctgcctcaaagattccactacctcataccaaaaatgtacagccaactatcctgagaacaaattctcatatttttccattatttccttttgaaaaggagcccaggtagaaaaagaaaacattcactattttggtgtgtgggtctaaaagacaatcctgctctcagtgccaatctgaacccacaaaaagcattgaattgtcaaatcggactcacattgaagattttgctcagtatcatgctttctgaataatttcaaagataaaataatcatgtatgggttaagtggggagagacctgtgtcctttcatcttcattgaatgtggtctcatccaagtttctagatttggtttctaagtaaaatgtacagttgctttacttactcaggtgtattctcagttacaaaccatctccttttatacttagatagcaacacagctaacgtgacattttcttgggaatcatcaccctacatttattgattcctggcttatttttcataagcaattttagacaactctgcatggtctgctagaaacattttatgaagaatgattctttggctaccaaaaactatttagtttattttctaagagacttgcattaatatgtttgcagaaaaattaaaccagaacacctgacttctttatttcccaggagttttcctccacacctgcccccatcaggggagaaaattgatcaggaggtaccacccctttccacaccattcttgaatctattctacagaactctctcacatggtctagcaatatgtttaaggtagaaccctttttctatcaatatttcttatgtgttaaatttgcattattatatgttgactagaaattatatattccttcttaaacattaatcataatgaatctaaaaacctaatttatttcaaccaataaatttctctttaattcctgtcctcaacattcttgtcctcaatattcctattgttactgttacagttatgaaatcatcttaatgaaatcacagctagaccagtgcattaatttaaaacaatagcatcctttttctataatttaacttcttcaaacttttcttcactgttgtataatgataattactctaaaatgacaatctgatcattaaaactttaatcatttactctctgccaatttcataaataaatatttgattcacagttgttatttcttcttcaagatacatcaaataatccacctttatgaaaagcaatttactgtttcataaatgtgctttattatgtcacatattcagtcttttaaacattttgtgccatccttggtcatcaaataaatttctatctactaaacatgactgacttagcaaaacgatagccttagtttcatgcatgtctccatcaattttggaattgcttttatgcccaaactgcagtgggagaaaaacacacaacaaaattgtgttgattgttatctctttaaaaccacaaccttgaaaagcaaatgtgcctttaaggcggccaaacaagcccatttttcttttgttagccattgccttcttcctcttatgtaagattaacttatggattctttcctcatttcacacccctcacatacttttcttcaatctcaatgccagctgatgaccttgtttcctgtgtcaaaaaataaatacatagatagataaataacaatcaagaggaaatgtatgcagactcccactactacatatacttaacgccagtatctaaaattacacactactcatcctgcatattaatagagcagggtcttttctctggtactatggacaaactgagccagataattctatgtttgggatggggtgttggaaaggttgccttgtatgttgcaggatgtttagcaacatccctggcctctccaattcgatgctagtagtaactccattcacaagttgtgacaacagaaaacatctccaaacattgccaattggctccttgcagagtgaaatctctccttaaagaaaaccactgccagaaatgaaatgtttatacacctacctcaagcttacgcctttacttgttcatcaactctttctgactacacaggctatagacagatacttttcaatacttacccctcttatacataatcaaattttcctctttattgggtcatttcatgatcatacaaataagctattacttctgtcatactagaaaataaaagcaaataagcaaccagtattcttcattttccccattttcattgtcagataccaccagggaatttgatccctttttcaccaaaactctttaaaaggataatttatagtcaccgtgtcatttgctccttgcattttctctttaatcatttcatttccatacagatttttgccccccactactctaattaaacctgtcctccactttgttaatcttatagttatttttctcaccttacttgatttatcagcagcatttgaagtagattattctcataatactatcttcatttgactccctggttttatattatttgtatacttctctctctctctgtctccctctctctctctctctctcttttagtgttttcttctattcctcagactcaatgttggaatgctccaggcctcagtattttatttccccccaccatcatctttctctgtacttctttccttggttatctcatccaatctcgtggttttacatgcagtgtaaatgctaatgactcccaaatttatatttccatgccatatctctatcccaaattccacacgcataaatccaattgcattttttacacttccacctgaatgtcgtgatgataatgggtctatttttcctgagacccattcctcactctgcccagttcagttcataagacagaggggatgaacactgtggattatgtagctcagattttctgaaagctggcttccagttaggctcaaacaataggagacacatgtagaaagatgaaaggcaggaacaaggagaaatctagatattgtctcattttctccctgtcatccctaataacagttacattttttacaggctcctgctcctttacataggcccactgtggttccagcttcccccaaatatccctccctgcagctccagtagtacagcctcctatccctgttctccaagggaaggtgatagtagcctcccattgttgctaaattgtaggttgcctcactgtcccctggttggctttaatttttttaaagttatttctaccatcaattacctgtatcaattccctttgttttaaattctcaatgatttcagttttcctggctagtttctgattacttcagatacctaatggaaatctcaaagaaagtatgactcaagagaaattgttgatttccatctcccagctactaccaaacctgtttatgcttatccatttcatttgatggcaagtccttcctctggttgcttaaacccaaagactttataatatgtagaatcaactacttctcaccatgtctactgaggtgtgaattactactgttttcctcttggataaagtcaatatctaaagaggggacttttcctaaaagtgtcctcttacagtcagttaccaacacaatatccacagtcatcctttttacataaaagagcgtgtcacttctcttcttaggacctgtagtgaccctctctttcattgatggtaaaattctaaggcagtgtgagttttaaaataccctgtaaatatgtacaattattatgtcatttaaatataatatatatttttaaaaattaaaaacgtatatcaaggcccaaattacttctgtgtgctcatcgttaactccccttcctcactcatctccagccacactggtttccttgaaccccttcaaacaagccagatatggggctgtcttgggcttttgcaccgtcttttccctctgcctgggttcccttctttcagatatctacatgtttaatccctcaccacctttaaatttttgcataaatgctatcttttcaatgatgttttctatggcctccctacttagcatctcaacctgtttcttggaccagcattagaaaatgaatatagagagatgaacacaatatatatggccctgccctcatagtcctagcaatctacagggacacaaaataatatgcaaaaaagtatttgaattatcttcagcacctttctaaagaaaaaaagctacttaaaacttacacttagaaatgctcaatatgagtcaatacattatgtcaccacctaaagtaacaagatgttaggctgcaactgctgtatgttttgaatgagactcattacactatgaagtcacatacttgtttaatattataataagacagaactaaatttaaatcatagttataccaaacactagctacactgaatctctacatctcaatgttctcaccagcaaaatcaagcttataataatactagcttcttcaagttatttaaaagataaatgagctaagacatgtaatgctcatagcccatttagaaaggcaaaatataaggtgtagtacatagaaaccactgaccattggtaattctgaaacactacaggtcagacagtttgaatgaaccatatactaaaggttggaaaagttatttgattaaactctgccttttttttttctgggaagaacacatagattaatcactttgtataatcccaacctctcccttcttgggagtggggataggggaaacagttttcatcatctatgatcttaagtttcctcatgctctttctcattgttaagacaataccacttattttagcttattgttacaatagtatttcatttttttctaacaacttggtattagtcaagatgggatataataacaaatgactcttgaaatcttcatgggtgccatgggaagtttcaagaacacaacttgaaagtgaattgcatgactttgttctgtgtttcattgaccactactcattcagtgagcctgaaagtaactgtgtatatcactgttagtatactatgcatgccagatacccaagactcaaacttttcctttcctttagataccacctacttagtcatcaattttggttcaacctactccactaaatagctttgacttccattcacttaccactttagattagtgctatagactcctattttacctccttcatatcaatccccttaaaactcccaatagcttccattgtttcaaccaaaagctcaaattcctttaatataaagtgttatatgaactggcaccctatatactctatatcctaatctctcatctttcatttatttctttaactcctgactcatgtaacaaaaatgtatttatctcagcacgtatgtactcccttgttatgctctcccaaatgtccctgtatttttcattgaatagcaattgccacattttattttatatgcttgtgttaccatttatatatatatttactacagactctgcttttagaaggcatacactggccaggcgcagtggctcacacctgtaatcccagcactttgggaggctgaggctggcggatcatgaggtcaggagatcgagaccatcctggctaacacggtgtaactccatctctactaaaaatacaaaaaataagccgggcgtggtggcgggcgcctgtagtcccagctactcgggagactgaagcaggagaatggtgtgaacccaggaggcggagcttgcagtgagccgagatcgtgccactgcactctagcctgggcgacagagtgagaatctgtctcaaaaaaaaaaaaaaagaaggcatacactgtgatatttgcaacatcaaacaaacaaacaaacaaactaaaattggaagaatacccaaaaataactcaaaggaataattttaatttcaattaattgattatggcctttatcattttaagatttttatatgtctacttttatgaactctaggctagttttttccacttttatttctacaatcatggggcctattttatattttctcttgcacttgattatagaagagattgaaatgagttaggaaacatgtacttgaaaccaataatgggcacactttacaggatttcaaaatctaaaaatatcataacataacttcagggaagagtaagaagtattggtgtcatttttttccttttagtagattagttgaagaggtaaattgaacatggactatatgtcagacttttttttccaaattatattcttaaatatatagtaaaacatatgctagagacagttttttaataacaaacaatatttgaattgagatcctgaagaaaaataaattaactgtgtaaaaatgtattactaaatatctgcattttctagagatgtatccttaagtatgtaggtataaaattacactctgagatatatttttaaaataatttggcaagaagagaacagggataccttaagcagaaacaacaaaattatgataattgttgaatatgtgtgatggttgtatgttaatgtattgattattttgtgtgggtatgaaaacatgataataaaatcaaattacaaaaaaataaaaaatacctcttgcttttttagcagcttattacattgtttataacagtgtctacagcgctatgattggtcagagccagagactataacatttaataaaacgagtcctctagaagctcatgggagttcatttacggcagcaaagacctatattaaatggactgaatatttaaggagtaattatgttgagtaatgtgtttatttatagttttaattatacattatcttttttggttatctttaaaatatattaagcttatgcaaataggatatgcatcataacccaggatctattatctgaattgcttatatacttataataacataactttaaaagaaagaatcaaaccatattgctagcttacaggttggatctttctagacaatagttatttacctgaatgtttatttttgttttgcatcttcatcagttaaaaccaacagttacaatacaaatgaaagttaaaaaataataatattattaatgtgaaatttcaatgtgcttagcaataaataatgggaataagaattatccaggatgtactaaatgctacaagaattatataagtctaatgaacatgatgcttttgaacttaagtaaattctatgtgcttaactatttttattgtttatagatttaggacttctgaatgcattcttttttgctgttatgggatattatgaattcaccttagtagacttttgcttacaggacataaaattaatttattctatgaattttttcttcttttcctaaaaatgtgtaagttctgtgatttcttggactaaaagatatctatttacatagtgaaaggccaggccttgtaaagatcgtgacagtattcaatcctattctcgtttttttgtttcaatgtgttgctagttatcttatctcagtgtattgtatttatataactgcatatttgattaagatacctaacctatgagacatattaacataatgaacacatgtaagcacacaacccaatttaagcataagaacagtatcaataattttgcagttatctttcactctttttcagtcacacagagacaactatactcttaattttgtgtttagagtcctctattttcttaatagacagattgcacatggttaaaggtctatgtttacatcaagagagcctgtgtctggatcttgttcaccccgcttatgtctcttttgaagttatgcttaagctttatcccttgttcctttatggaaatttgagtattttaggaaaagtaaaaaaaaaaaaaaaaaagaaactttaaagtagaatgataaaatctagtgtttttagatacagaagtgagaagctgaatacgggtaaagcatgatggactatgggaagaacggaatttcttgtgtgtgactgctcattcaataagctatattttttaaagacctgaacaggttatagctattggttatctacaagtggaattctcaaacacgaaaatgaaagcctgacaaataagatgctaatgccattttcacttaaaaaatagaacaagcgaaagagagaaataaaagcactagcccagtaagaacatcttctatttgccttactcataagccatttcagggccatagctgcaaaactaggaagaaactgctaagtgctaaaacattttaaccaatcactttaagaaaggcagaggaagcaaatcactctagtagataaaacaggagagactgaagttgctatagttgtaatctttttaaaaataatctatttgttttgaagaaaaccccaataggaaggtgttttcatttttaaaggtatctctcttcagatactatttaatactcaatgtgctaataatgtcaaaaattgttaaatgcgtatatatctgtatttcaaataggatagtttatcaagtcaggttttccaagaagctgatactatgcaattataagtcactcaaaaggttatgagaggaacgttagttaaagattaagaagaaaaagcagatctaagtgcagggagtcttcagtgatgcaagcctggcttctgtcaaaggaggggaagaaggatgagaatgaaagagtcacagcctgaaacacagtttaggaagttttggcccggacaataggagtctccagtccaaagtcttctgttggaaggttatcacaaatcttaaaaatggccttcatcaatactccgagcatgctcagtcattggccaggaacagccagagaaaatatggtctgagtgcaaagatagtcatacaaccagaaaaacagtagctggggctgcctgtcatccatgctcactgaagcaagagttgtgagtggtgaccacatatatcaaatatttctatgaaaaaaacaaaacaaaacaaaacccaatcaagtgaaactccaaaatgataacctttaatgcttattaggtggcacaagtgttaggttgggtattttactaaatatttaatcattatatatgcacatatttatgggcatgtgagcttaatttctgtttttaaattcagaatgcttcaataataacattgcattttatataatcctgattttcttttttaaaatcagctcaaaaggagaagttaaatattcagctttaatttcaccagtagatttttaatgttttgtaatcataatgtttaatttgtgctgttcttagaactttaattatgaagctaaattgtactaatacccattaggtacttcttaattgaaggcacatcatatgtctgatgtggcagtactaattggtgtaattaaattctaatatgcttcagtagcctgatttttttaagggaataaaaagctgatagaaataagtcagctcttgaagctgcatagttgtataatacatacacgtgtttgcatttgtaacatgcacatttattcagaagaaacaactcattaatttattccaaaaccatttcacctgataacttaaaatacagagtaaaacaaattggtcaggtaaatatacatgtaacttaaaaagaaacagtcatgtactttaggcataaggacaatgcttttctcttttacaaattctaagttaggtcaaattctctgaaagtcactacctttctttactgtgatgtgttttcggtgaagttacagcctatttgcaaatcacatcactggtttgtccaagcagaggtagatgagaggtaagctcctgtcctgctaaaagtctcctaaaaacagcaagaaaatatttttacatgttcaaaaatgctcatttatttatattcctaaattttcttttactcagtataatatagataatttaaaaataagtagaatatttttattatatatgttttatttttatacatctagttaaattaatagtggaacattatatatctgttaaatgttttaaattacatggaattaaaatatcaaagttaattatgttattataatttttaaatttcagaaaccttctttaaaattcttactgttttatcttaaaaaattcatatagaaattgtggtcagatgtaaactgtgactctgagcacaaatcccaatgctattgccaattaaattccaatttttgtgttcacacatgaaatgtagtttttcttttattgagttttaaaaatctgtaagatttacctatctgaatatacactcaggtctagcttcatgttcctgtgacctctgtggtcacacaaggacccatgtacataatgacctcatacttggcctaatgctctgctgttgccatcttgaaacgcttaacactttgaacgaggtacaacatccacttcattttgcactgggccctgcaaatcacgtagacagtcatatatgagtccagtattttcctaccaccagacattttgatgtactgaagagataaaaaaaaaaacctaataattagaagttttaaaagaattttttttttttttttggaagactagagttttattactgaaatcagtctcccccaaaatttagagactgcatttttttatttttttttaatttttttattgataattcttgggtgtttctcacagagggggatttggcagggtcatgggacaatagtggagggaaggtcagcagataaacaagcgcctctgcccggccgcccctactgggaagtgaggagcccctctgcccggccagccgccccgtccgggagggaggtgggggtgtcagccccccgcccggccagccgccccgtccgggagggaggtggggggggtcagcacccccgcccggccagccgccccgtccgggaggtgaggggcgcctctgcccggccgcccctactgggaagtgaggagcccctctgcccggccaccacccggtctgggaggtgtgcccaacagctcattgagaacgggccaggatgacaatggcggctttgtggaatagaaaggcgggaaaggtggggaaaagattgagaaatcggatggttgccgtgtctgtgtagaaagaagtagacatgggagacttttcattttgttctgcactaagaaaaattcctctgccttgggatcctgttgatctgtgaccttacccccaaccctgtgctctctgaaacatgtgctgtgtccactcagggttaaatggattaagggcggtgcaagatgtgctttgttaaacagatgcttgaaggcagcatgctcgttaagagtcatcaccaatccctaatctcaagtaatcagggacacaaacactgcggaaggccgcagggtcctctgcctaggaaaaccagagaccttaaaagaatatttttaagagttgttgtttgtttgtttgttttttaatcctagatgtctcaagcttgccttccattagataatgcagtaaggaacccccagtttacaacacagggcaggcaggaagacaaccaactcaatgggatctctgtcctgtgtagtcatcaccagctgatccttctttttctccgctaaggtggtgacagcgttaacccccattaaaaggacaggtgatctctcagtggggatgtctcctttgctttcttctcagcccaggccaacagtctctgctgcttctcttgctttgtctctggtctgtacttgccagccagcttaccccattgagcagctgtttggtggtccaaggccctggtgaactgactaatcacagaaggcacttctagctgcttatagaggatggctctctgctgctgcaacctagtataatggggccatttgacaaagcaagtgaggtcccttttgggctggatgttctgtccaatgccaaaatgtcctgtccagtgccaaatttctcaaatggaagattcaccactttcatggtctcctgctttttcaagaccgcaagggtcagcaccaccttcttccctttggccttctttctttttcgcaccttgggtagctggagaacagaataataagatcttgagagaaaaataagttgaagccagaggtaaaactgaatattggtaatatctttttgttttagggttgctttccattttagaaagtaattcagagtgttattttttaaaaatcatatatcagagttctctaataaatttcaaacttaaaagaacatttaacttcataagagaagagaaatgtttcatgaacatattttaaagatagggaaactagaatacaatttggagtaaaactaatattttaagtaacctggagataggactcatatcttttaatagaacatgcattctaacaagccagtgatttttcaaagttttctaaaacacttttctcaaaccacatttaacctagaagtagaaacaaataaaagacacaaaattagagttaattttattgtaactgggttggctccagagattatagttaggaagtgattacattaagctctacatatgcagcattctagcaaatttcaatgcagtagacaaaatctataaataatgtgaaacacatattaacatgttaagcataatatgcattcattgtcttcaacagaatagttctctattaattttttaaatgtaatacaattttactttaaaaacactgaaaaatcaacatatttcattaagaaaaaattataaatgttgcaaaatgatgatgaaaatatgtatagtaataattcccaactataacaattttgttttatctaatactggtcagctttccatgtgtccaagcattacaggacttttcattaagcctaatcctcacaagaacattgctttgagcgatgttccagagtggtagtcctttaaggcattagaacgatttgtgaaatccctaaaaatactaggggaaatattcaaaaaatgacaatagtgccattattcctcctcctcaaagagactatcagaactaaaactctttgcttcatgttcctgtttacttctgtcactttcaagtcacagaggtattatcagactgtcatcattgtatgactctgcttttccaacagaatcaattacctatcccttatctcacaacttgatagtgatagatattgaatgcttatgttctgattagcaaactctttttgcatttttaataacaacttgaactcctgatatgtctggaaaatataaccccttcaacagccctttcaatgggttgctactattttgctcaccccatcttcacctgcctaatcatgaggaggcggggtatatacaatttcagttaatttgtagttatcagtctattatagttctttccttctgaaaaccaacaagtaaataaaccagcaagcatcaccaataaactttgacagtttatggttcataacgtacgtctacaccaaactttccattcaaatgctttttcaaacctttgtttggtttctttctctattaagacaacttttgcttttggctttcaaagacattctctccattataaactctgtcgttattctctattgtgcttacctcaaactggtaactctttcaaatcttacctgtcagtttcttgaccaccatgcatgttaataacatttcttctctattttagacagcaaatgtttctcaatattaaaaaaaaaaaaaaatcctactctttggtcctctctacctcccatttcatccaatatcgcttgttcaagacctgaactcgtacaggtttttaacctgttgaagactgtcactctatggactctactctcttctctctcctccatagccttctcattgcctatcttccctacttgtccaggaaatgatgacatgtttcatcactataattaatccatttcaaatggcctttatgccaaatgattttattatatactctttctgtgccatgccttgttttccaaatttaccacagtacaaattttacaattagttttccattactgaattagtaccaatctctgtcttaaaaaataaatacagtaaaaaatgataatgaatttatttcttcttataatactatcactggtgcatggttagaataaattaatcttaggatgatataagcatttctccaaatggtcttcaaattcattgatttttttgtgatttcaatttccatatttattgttcctgttgcaattttttcagattttatatgtattaactcagaacacatacctcttatcacacatattttttcatgtaatttatctaaatcttatagaaaagggtacatttgcattttctcttattagactcctgatttcaaataatatattacttatgagtatttttctgtgctgtagttattcattctcatagatatgtaacataattccttttgcaaaggtaaaaattgagctatctcttgttgaggatttgttgatctctgtctaaagtttcaaaaataagaactttaaaagcaaaatgtaaattcctttcaagttttagtaaaattacttcaaacttagtagcttaaacaatacagatttattatgttacagttctgtaagacagaaatctgacttgatcacaccatggtaaaaccaagatactgccagggttggttttttcttgggggggggtctgtgggaagagtttgtttcctttggttttccacagcccagaggctgcttgctcctttgatcactgtcccttcctccatttttaaaatgaggaatggagtcagggtgactatggttagcaatattgtattgtatatttcaaaatagctagaagagaggatttttgaattctctcaccgtaaagatatcaaagatgtatgaagtgaagaatatgttgaatatcctgattcaatatttaaactatacatacacgtgttgaaacatcacactgtatcccataaatatgtacaataattatgtgtcataaaacaagatttaaattgttttaaagggccagcaatggcagtttgtgagttcccatctcatcactctaacttcttctgcctccttccacttgtaaatgtccttctgattattttggtcccatcaggataatccagaataactttcctatcttaatatcaactgacgaacaaccttagtttagtctacaatttcaattttcctttgccatgcaactaacatattcacaaattctggggactagaatgtggacacccgttgtattagtttgtcctcacactgctaataaagacacagctgagactgggtaatttataaaagaaagaggtttaactgacttatagttccacatggctggtgagccctcaaaatcatggtggaaagcgaatgagaagcaatgttgcatcccacgtggtggcaggcaagagagcttgtgcaggagaactcccgtttataaacccagcagatctcgtgaaacttatttactaccacaagaacagcatgggataaaccttccccatgattaaattctctctacctgaccccattcttcacatggaattattacaattcaaggtgagatttgggtggggatacagccaaatcacatcatttgtggagagctgtgattctgcctaccacaagtaagatgtacaaagcatggaaggagctacagccagaaacaattataccattgggaatttctagcagaataaatagcagttattaactgataagttaatagattaagtaaacctaaataattgccttcattagcagcgaggcttttgatggtccatgtatcacagatatttaaacacaaatacatttttctcatttattccaataacaaagtgttttttggtttgttttgttttgtttttgaaagtttggtatgagagagaaagagatgagctgatttgactactccaggctagaggatatgtagctgagagtctatggctgagtggaggaaaaaaaaaaatcacaagccctgtccaggataacagagagagaaagctgtttctgttgagatttgatggcccccatcacaccaaatttgggcttctagctagcctcagttcttcagataactgaccttccttctttcctccctcttgtaatagtctttgtgtattagaagtaccttgaaatgctgggtcagaaaatgtggcacgaaagagaaaagctggctcactccacatcttgacctgatcatttcctgaacatgattgaggtggatgactctttgctcctctttggctgacctgcaggaataacattgggaataagcaaatctcctttggactccagagggtggtggtcaggaagtgggccattgagaacctaggtggaaatgcaggccagattattggagtagtttgctttataatgttaaaatatttatacacatgttatgtgggcctctatttccactcttatcttagagcccacacgtattatggagggtctagcagtgtttgtggagtttttggtactatacctttttcaagataaagtaaaaaacatttatggataatttaattgttccctatgtagattccagtgccaaattcctctcttagacactgtttctagtataacatgttaatatgtgacccctgtttcacttacagatttttagagatctatcccaggttacttaattcaactccaagacatacttttcttttaaatgcagggaataaagggtcagttacttagttactccggttttatttaatcctactgtcatctgacaatatggtactgatactatttcctatttctagatggttgctagaaatatactgtaatatttattcttgatatatgtttgttactttaacgggaatacataggctataaatagtccccttgcctctcacaagttagacagtcctgcccagaatgccctgctgaagagttgtagcagatcaccctgttcctccttaacctctctgttccgcatatgctcacctgtaaaatagtgatcatagtaacacccatcttgtgatgatgtagagaggtttaaagaagcaaattaggggaggccaggcatggtggcttatgcctgtaattccagcactttgggagtccaatcacttgaaatcaggagttcgagaccagcctggccaacatggtgaaacccacttctactaaagcaaacaaacaaacaaacaaaaaacacaaaaattaactgggcattgtggcagttgcttctaatcccagctacttggttggctgaggcaggagaatccgctggacccaggaggcggaggttgcagtgagccgaggtcacaccactgcactccagcttgggtaacagagcaaggttttgtctcaaaaaaaaaaaaaaaaaagaaagaaaccaattagggtggaaacacttagagcagggtgttcataagttgtcaccctcttgaagcaattgttggacactattttaaaaatgttttacttctgagtgaaatgttgcattttattttactggaagattcttatgtagtttaagtacattttacggtattgtcaaagagcatgagcaaaatatttaggaaagatgagaccatatttcttttatttatgacattgccacaaaaaatcaggtagatgaatttgtattaagtttttgtaccaatttcatatctaaaatttcaaagaattttattgcaacaaactctttcttaccattaactcaaaaaaattctgttttaaattgacttcattccataagtctctacactactaatttggccagaagttattttcaatcctaattgggaacaacaaagatccacatgatatcctttcaatttatgatgttgaagaaagttgaattgtaataatttgagtgtgcagtcaaagcaattttcaatactatgtatcactgtagaaacaagggagaatgtcttggttaactatttaagtggcttgagtatggcaattaaaatttcatctaagctcattttgatgaatcttgaaggtgacatttatttcttatgctctgaacatcgtaagttctgttgatttttatgggaagttttcaaggtcattttcagagatctatgacaaaatgacattatttgagaaaaaaaagaagaaatagctcgaagtttaaagcattatggtattccctaagcccaaaattttctccctttacaaaaacaaatgaaaggcaaaatagacaaacaaagaaaccatcaaaaataccttgaatcactgttggtgggaatgaaaattagttcgaccattgtggaagacagtgtggagattcctcatggatctagaatcagaaatcccatgacccagtagtcacattacttggtatatacccaaaggaatataaatcattctattatgaagacacatgcacacatatgtttattgcagcagctatactacttattatagcaaagacatggaaccaacccaaatgcccatcagtgatagactagataaagaaaatgtggtacatatacaccatggaatactatgcagccatctaaagaactagatcatatcctttgtaggaacatggaaaccaccatcctcatcaaactaacacaggaacagaaacccaaacacctcatgttctcactcataagtgagagttgatcaacgagaacacattgacacagggaggggaacaacacacagtggggcctgttggggcgtggggggaaaggggagggagagcatcaggactgatatctaatgcatgcagcttaaaacctagatgatggtttgataggggcagcaaaccaccatggcacatgtatacctatgtaacaaacctgcaaattctgcatatgtatcccagaaattaaagtaaaataaaataaaataataaaaacaacaacaaaatgtaccttgaatctccaaaataagttaagacaaatagttaaaattgagcatgcttttattagaagaagaaaatgtcattgacaatataacagataatttatagatgggaacatacgtaaaaacgtataagtacttagatctgctagataaagtgagtcccaaatgataaggttacaaaaataatgtttttttgtagaatatgtgttttcaatgagaaagtgttgcaaaagtcagtcatacagattggtaacttttatgtttatttttcaaaagcagctcaaaatagttctttagattctgtaacaccacggtgtcctaattttgctcctaaaattttgtcacaaaagtttaaattcacttgcaaattgatcttcatttaatcttcctctaggtgtgtaagctaaatcagagatctgcatgaactgcttattactctttcatgctatacattctccctaggtaattttgatcactgcaatcttttccatcatcatttctacttgaagactaactaatataggtagaacaaatttcaacttctagacctatatgctttccagatatctcaaataaaagataaaatttggggagatataccatgttcatgattttgaaatagtcaagactgtgtgatattgtcctcaagaaagactaaatagatcaacagaacagaatagaaaatacaaaaacagatttatacatatagttaaaatctttttttttaaatagcaagtcaattcatcagggaaagtatcagctttgaagaaatggaagagttttcaaagcaagaaatgtaaaacagttgggtatttataagcaatagaaaaacaaatttgattcatagcttgcaaaatatataaacattaataaaaagccaacctgaatgtattgaaatcttagatataaacataagataaatctttgtgaccttagttgaaacaaataagtgctgtatatgacattaaacatttaatatgtaaaataaaatattaacttgaacttcttcaaaagtgaaaatttttactctttttaaaaaattattatactttaagttcagaatgtgcagaatgtgtaggtttgttacataggtatatacatgccatggtggtttgctgcacccttcaacccatcatctattttaggtatttctcctaatgctatccctccccaagccccccaccccctgacaggccccagtgtgtgatgttcccttccctgtgtccatgtgttctaatttttcagctcccaattatgagtgagaacatgcggtgtttggttttctgttcctgtgttagtttgctgagaatgatcgtttccagctttatccatgtccctgcaaaggacatgaactcatccttttttatggctgcatagtgttccatagtgtatatgtgccacatttgctttatccagtctatgattgatgggcatttgtgttggttccaagtctttgctattgtgaacagtgctgcaataaacctacgtgtgcatgtgtctttatactagaatgattcataatcctttttctatttagtaatgggattgctgggtcaaacggtatttctagttctagatccttgaagaatcaccacactgtcttccacaatggttgaactaatttacactttcaccaacagtgtaaaagtgttcctatttctccacatcctctccagcatctgttgttttctgactttttaatgatcaccattctaaccagagtgagatggtatctcattgtggttttgatttgcatttccctaatgacgaatgatgatgagcttttttttcacatgttttttggccgcataaatgtcttcttttgagaagtgtctgttcatatcctttgaccacttttcgatggggttgtttgtattttttcttgcaaatttgtttaagttctttgtagattctggatattagccctttgtcagatggatagattgcaaaaattttctcccattctgtaggttgcctgttcactctgatgatagtttattttgctgtgcagaagctctttaatttaattagatcccattcatcaattttggcttttgttgccaatgcatttgatgttgtagtcatgaagtttttgtccatgcctatgtcctgaatggtattgcctaggtgttctgctaaggtttttatagttttaggtcttatgtttaaggcttcaatccatcttgggtgaatttttgtataagatgtaaggaagggatccagtttcagttttccactacccagttttcccaataccatttattaaatagggaatcctttccccattgcttgtttttgtcaggtttgtcaaagatcagatggctgtagatgtgtggctttatttcttaggcctctgttctgttctgttggtctacataactgttttggtaccagtaccatgctgttttggttactgtagccttgcagtatattttaaagtcaggtcgcatgatacttccagctttgttctttttgcttaggattgtcttggctatacaacctcttttttggttttgtatgaaatttaaagtaggtttttctaattctgtgaagaaagtcaatggtagtttgatggggatagcattgaatttataaattacttcagcagtatggacattttcatattgattcttcctatccatgagcatggaatagtttgccatttgtttgtgtcctctcctatttccttgaacagtggtttgtagttctccttgaggagatccttcacatcccttgtaagttgttttcctaggtattttattctctttgtagcaattgtgaataggagttcactcatgatttggctctctgtttgtctgttgttgttgtataggaatgcttgttatttttgcacattgattttgaatcctgagattttgctgaagttgcttatcagcttaaggagataagctgagacgatggggttttctaaatatacaatcttgtcatctgcaaacagagacaatttgacttcctctcttcctgtttgaatacgctttattgctttctcttgcctgattgccttggctagaactttcaatactatgcttaataggaatggaaaagggcatttaaaaataattttttaaaaactatgaactgagaaaacatttgaatagcatatatcttattggccaagaaaggtttatctcatcaggactaatgtttgtctttagaactggcacttggctggcttttggaagataacctgtgggcccttaatatattctgcctgttgacagtgtttctatacatctttggctttagagtacagtgcacaagtggttttcagcgtctgaggccttggaccatgctgtgctcatttgaacagataagcttatcctaacaatataatttagagtcaatggctatattttctctgacagatgctgtagtctgagtagctgaaatcactcatataggcaccaccttacatgactgatgcccagtaaaagccctggagaccaaaacttaaatgagcttctctgattgacaacacttcaatatgctgtcaaatattgttgctgggagaattacgtgtgttcttatgggattccactgggagaggacacctgaaagcttgtacctgatatcttctacatttctccccatgggctttttttctttgttgattttaatctgtatcttttcattgtagtaaactgtaactatgaatgtaatgtgttttctaagacctgtgaatcattatagttaatctttgagcctaagggtggtcataaggagccccaacacactaataaattactttcataaagaatatataaaagctgtcaaaaatcaaaaataaaacaaatcacccaattttttaaaaggcaaaagattgaaaaagacgtcatgatagaagacatggatgacaaataagtatatcaaaaaattttaacatctgtagtcattaaagaattgaaaaccacaaagaaatactactgatagttattacaatgtccaaagtgaaaaaaaatattgaccctaccaggtatatgcaacaaaatggaggaactgaaacgttaatatacttttgattgacaaccactttgtaaaatagatagattgacagcttcttaaaaaagtaaacctatgcttaccacttaatctagtcatttatcttctagatatttccccctcgaaaaatgaaaaagaaattgttgtatataaatattcataggcattttctctttaatagctaaaatgtggtcatgacccacatattcattaacaagtaattggtgatatatacgtacagcaaaattctgctcagcaatgaaaaggttcgactactgacacatgcaacaacatgaatgaatttcaaaagaattttgctgtaaagcaaaaatgccagccaaaaaatagtgcaccttatatgattccatttatataaaacttctggatgcaccaatatacaatatacagtaatatacaatactgaaagatggtcagcagttgtctagctaagatgcttattaggagagacaataattgcaaaaggggattattaaaagtagtcatgaggaaacattttgtggatttatatgttcactatcttgacaataatgatgatctcacggatgtataaatatgtcagagcatatctaataatttatcttacatatttttggcttttaatatgttaattatagctcaataaatttcttaaaaactcattggactctatctgtaatgtgtgtatgtttagttttaagtagagtgcagctaaatttttctccaccattacaattttcaaacatactttcacttacagaatagcatactgaaaattaacacatgcttttataattataaataaaatagtaatatatcatttctgctgaaataaatgcaaaccaattacaaggaatttattagtttttattttagttacttcatatatattagcatctaagcctcaaagattcactatgtaattgtgtaaattagtagtagggttacctgaatctggcttaatagtgaattaatcagtatttatctttaaacattttttcctttatgaattgtgtcacacttttaaagagcccttcctacattacaagcatgtataaaatatattcttatactattttagaataatttcagaagttagattgttttctagatttagtgttttcattgataccaaatttatttttatgtacataaatgtatgattttaagttagattatttcaaactggtatccctgcaattatctgaacaaaaattttttttttttttttttttttttttttgagacggagtctcgctctgtcgcccaggccagactgcggactgcagtggcgcaatctcggctcactgcaagctccgcttcccaggttcacgccattctcctgcctcagcctcccgagtagctgggactacaggcgcccgccactgcgcccggctaattttttgtatatttagtagagacggggtttcaccttgttagccaggatggtctcgatctcctgacctcatgatccacccgcctcggcctcccaaagtgctgggattacaggcgtgagcgaccgcgcccggcccaacaaaatttttaagtagtcacattgacttttttttcaaaagttagttttaagctatttgataacatatggatctacttcactaaagttgtatttttgtgtgtaattctttaatccatctggagatattttggttgtttttcgatcagatagccagttaaaccagaaagaaaaatcttaccaaaaagtttccacttagaaaatttaatagccaaaaaaactaatatatgcaagaatgaacaaaaacatattgataaaagttatacatcatatttttattgaaatatttcataatgaaatgtttcacatggttaaagaactacaaattcatccagtgtaaataaaaacttcatgggaaatgtataatatatgagggattatttgatatctgaaaaaactagatagaaaataaatgcttaaaaacttctagaaggtaatccagtagagtatttatcagcttaggctaacaaatgatataaacatgattaaagaagagctaaacttgaataaaaatattaagttgatgacaagtgtaaaacaccattcttcaaaatatgcaattacaaataggaaagtgctaataggagaaaaaataagatgtttataatgcaaaaagtattaacattcaaaactgttgataatataaagaaagatattataaggaaaagtattccagtattagagtagcctaagtataaggcaatttgaagaaagaaaagaggaatcatgaataggtttatcaatcctgattccatctcaccagtgattagactggtaaataagaaaatgtgtgataataccaagggtaataaagatatatttcatttacatttacagtgctggtaaacatacactgtacaaccactttggagaaaacttggaagtacctaaaatgtgaaaatgcacagttgctcttgatccagcaagggtacctctgagtatatattgtggaaaaattctcacacatgcatacacagtgaaacatgtaagagtgcttatagcagcagtgttgggattttctttaaaccctagatttgacctatatatctatcagtagagaatcaaaatataattcaagctattgttatacagtgggatatagtacatcactgataattaatacaaattaatattacgaaccactcaagtttgaatcaaatattaggtcatggtataatgaaattataaaactatttagagttaaaaacaggcaaaaatgtcacatttattttagaattcataattgaatagtagaagaaagtaaaaatgcataggaatcatcaacatgaaacacaggaaaaataaatgaaacataggcaggtgattatctgcagagcaagaaagtagagtttattaaggagggcagtatgagaactatctaagatattttaggataagaagcggttttgtgaatttgaattcattaaataacgctttctattttgttttgttattcatcatttaacatttttttaaaaaatataaagaattctcataagtatttttaaactagaagacaaataagtggaatgaaacatctaaatgtcaaattttggtgtgtacttcctattaatttctaagcagggacacctggcaagcagaaataactctgaggacatgtgggattttgaatttttggacacctctgtaaagttatttggcaagcaataataatagctaccacttatttatcaagtgtttactaatgtactaagcattgccatatatggtttattacttctatcctatttagtattcaaatcaatatgatgtctatttttgttctgttttaaaaataaagaagctaacatgtccaagccacatatttagtaagtattggaactacatcaaaacaagaaagaaacatttcaatggtttatcctactgtctacttcctaaaggaaaattataaatttacagtaactgatccaaatacatttccagagttactttagctttcacagtgttggccagcacaatgtgttttttgtttgtttgtttgcttgcttccttgttttttaattgagaacattcccatagttgactatttcaatatttaattctccaatcttgtatttttggtttatcttgataaacatcaaataaggtggaggcagtttacactgaatagacttaagaagctgatcttcacaagaaagttcagatgcttcattttaccacaatttctccactgcttagttttattacacctagtccatatcatgcatttgggttacttgcctggctcatctatgacagaaaagaaggaaaggagaaaggaagcaaaagagaataaagaacctaaataaatgctattcatctattcagagctgtttcaaaaaattaagtgaatgttttcttcagtattctcagtcaaatcttgcttcatacttattataaataccctgaaggagtcataccaatgtgttctctgtaaatgccatgaacaacactttgtttttgtataacggttttcatgactattgtattaatagcacattcaataatatttcaataggtcaaaattatgtcatatgttttcttacaaatttttgtcattttttagaattaatgctacagcccagaaaataaatattattatgaaagcttgtttgtaaaaaatttcagtaattttatatctttttggtaagattagtggcttctattgtatatatttacaatggatatcaatgttgatattgagttatccaatctaatattcttaatagctccagcttgaactatgaatggtagatgactatgttctgtacgtataccaatatgagtatttttctatgttaaagattttactagaatccttaaataaaccataatcatctaatatgattttctgctggaatttatataatttattatcataaaaatatattgaattgctcagataaaaattttaacttctataaatcttaatatataaaaatatggtcttcttcaacaaattgacattgcaaattggtttagaatatccttaaataattatagttttattttcaaataagctacttttgcaaattgttatcatttttaacttaacttttgtgttttgttttttgtttgtatttatgtcttccccaaatgtcctctttttttatgcaaatgtagagaaggcagacacctagaattccatcctagaattaagacgtgacaataaactttgattttgtgagtgcattgtacgctgacctaatagaagatgaaaagtggaaaaatttgcacaatgagttcaagaactctgaggaaaagtattcaaacagtctagttaagaaaaccttattaagtggaaatttcataccaaacaaggctgcacagcttggaaaagccctgcacttaaaattaacttcagccggtgatgtgctgaggctcttgactcaagtacaggcacacgggctggctatgatttggagaaacatggtaagtcatatgaatgttagttgataactaattttattgttcatgtgcggaggacatagggtcaaatgtgccccaagaagacctcgagaaaatatatgtggctctggatacagacctcatgtgacaaaaggaagcaataaccaggaaagactgattctctctgcttatcatttagaacaatcaaaataagtttgaaatgaaaaaaactccaggggttttgaaattattaaactggcatgtacatactaaaagggagccaataaggaatttactactaatagggcatgggggaaagcagatccaaagttctaattaatgttttaaaatgatggtatccatttgccagttttaagataagtccatactgctgaaaattgctctatgtttcttaccacatttatctatgtcagcatttattttacttctaaatttaattacaatttttaaattccattatacaagttatctcacatttaactatttgttacctttccttctcatcttacaatattacttctctacctgtcaaactatatacagtccagttcctattccaattatggctataattgcagtacaattaatcaattaattaacaaagcatagcaaaaaatcaaaagaactttaaaaaattatgtataattgtgatcaatgtggatgtttttaaatatgttcaactatttatactattttccttctcaaagaatcatcagaatgctgaacacataaaataaacattggataaattaaaaataatttttcattctaaacaatctaaagtaatttaagtatagttcctatttagacttaaccataacactttgaaaaacttgaaagaattcactgattttttataaaatttaaaattaatacatattacacaatttgtaatatagatttttactttgaacatgagggcattttaaatggagcttctttaaaatataattcacatataaaaatttcagaaaattttaaggacctttttctttttactaatgctttgattaggatttcagtctgcatacaaatttgtcaagattttagctgatactctttcaggaaactattttaatagatcattacctttccttatctctcaatgtcattagatatgtacattttaatcttaatttctaggacaaatatacatatctttttctgattatgtgcctctaagtttgataaaaagttcttgatgcaaccagtggactcaacacttctccttactttgcatttataataataggcttatagcagtttttttctccaaattaaagtataaatatttaatttttacttttaatttttaaatgttactcaatagtatgtttataaaatgacttctggaaaaacatgtctattttctatcatttattatgtcataattgagagaagcaaggacccaaattcatttaattataacacataaaactgaataaatatagatgacagatatgtgttctttgtttttacatatctgttgtaaaccatattactcagattatctcacttctttcaacttttctaataaaagcaattaccatacctatgtggaatgtattttaatagtaattcattttaataaaagttatatatttttaggaggtcaaaatagcaatttcaatttatgaaatgttgactttttaatcttattgacatattttctggaggcaaattgtagaactatttgaatagcaacagaaatttccagtggagagacagtcagatacgaaacttccgtgagaaaactgtatttatcagtgactgaaaatccttggattaggacctaactcccacctacttgttcttgtagatactctgtctaaatacagatatagatagatacagatacagatacagatacagatatagacatagatacaagtacagttacatagaaaaataatattataagatatcctgaaatatatataatatgttagtttctaacattgttttaaaagttagttgtttaaccaatcaaagcagaaacaacttaaacagactttacaaaaattcatcagatttaataaagttgtctattcgaagatagggacttctttcttttttaaaaattaaatgagaaagcaactattggcaaattcaaattcctttcttatcaaaacacgtattttgaatttttattgtttaaaacaatatagaatttgaattaatagctatcttagtaaggaaatatctttcctcaagactgcaatgtgctatcttgcatacaaaattaccaaataaacacagtgactgctgataaatttttacctaattatttaatatggttcccttgaaaaatgaatgattaaatgaattaaacaacagttaaacaattagattcagtatgaatattatgtgcatactgtacatacttttgtattttcaaggtcaatcattgcatagaaagaaattaatttttttaagaagttaaaaatatagtacttaatcttgaataaatttgttaataactagggcacattaaaatatgcctcaaacgtagtaaaattacattttaacatttatacaagaggttgtctagaatatcacaaaagaaaaataacctaaaaataaaaactttcccaaaacaaagactcaaaagcagcccaaaactgttacaacaataaaaataatgccacaatatttgtttctattttaattgaaaaaaggaaaagcagatttagttattactctaaatagatactttattgttgatttttctagatttaatagattcaatagtttgaacttaaaaccgtatttctcaattttactctaattttctaacctcaaacttaaaacacatcatttccctctttattttcccaccaaccacacacactagccatgtcattctatttgtatttacctcattctttttcacatactctttgtgtgtgattctgctttaccatcttttagaatatcttttctcaatttttcacctatatcaaatattgttttaatatatagcatattaatagaaaagctaaggtatagtaaggcaaacagatcggaagacaattgccattgaaaagatactcacaatttccaagagaagggagcatgtcacgccaggggagactacagggaagaactcaggtccatcaggaaacagagagagggaggaattcacgagcaagaccctagactgtggtgtttgcaggaagaaaccaagcagggtaaacaagcttaggaccggctcgtttgaataatttcagtgggctctggggcataagagctgtccctggttctctggtttttggccctagcgtgattaggacagaagcacagtggcctggagtgtgacagccctatagagtatttgtttgggaattggttagtttgtatttgtaaagcccatcttcgtgaggagttcaggggagacttcgtagccagaagctgaggcaaggtgactccagcatactatccatcttcaagaacaagatgtgtctgaattgctgtatgttataaagtttcgatgtctaatagagcaaatctttcatcctgttggttctctttgatttaatttgcttttttttctctctaagtactgttctcggaataagccaatctgatatgtgtgtcactattccaatgaatgagtagatcacactttatttttctgcttcttgtgaacattaattagttcagttttctgaaattttcaatgctattgtgattttttaaaattaacaatgctactttgcttattgtgtacttgtcaccagaaatgcaagagctaagatgtctctggaaatggaattcctgggtcacagggttggcacatgatcaacattattagataatgttaaattgttgtacaatgtaatcacattaatttgtatgccaatagtagtatataaaagtttgaattgccctacatccaaactcacacaaaaataaatgcagtctaaaaaaaaaattataatgtgatgtatatgaaattatattttgggctgggcacagtggttcgtgcctgtaatcccaacactttgggaggccaaggtgggcggatcaacagaggtgaggagttcaagaccagcctggccaacatggggaaaccccgtctctactaaaaatacaaaaattagctgggcctggtggtgcgtgcctgtaatcccagctacttgagaggctgaggcaggagaatagcttgaatccaggaggtggatgttgcaatgagctgagatcatgccactgcactccagcctgagtgacagagtgagactccctctcaaaaaaaaaaaaaaaaaaagaaattgtattttgttgttttatagttttaatttgaattaataataagctttggtaccatttcatatattttaacttttttattatttaaaaactctgcttaggtattttcctattttaatttttatgtctttttctaaatccttaacataaattaattgtatcatgaattttaatagattgttatgtacttgcaaatgttgccatgctgtttatgatgatttttcattttaccaatggtgatttagaaggaacagatactcttgatatgagtgggaccaaacttacaaatcatcttgctccagtcagtttttgtgctggtttgaaaatttttttcatactctgagattcaggctaaattgcttttaaaattttaaagctttgtgtttcaaatttatattcttgatgagatgtatagagtgagaatgagatacattgtctttttattataaacaatcttgctttagtagctactgaagtttacttttgaaattgtatttcttaaatatttccgttaattatagaaaattgattttgtattctattttatatccattaactttgctcatttagtaattctaataatcctaggcattcttcacaatgcattgtaagataatgtatacatttcataggatgacaatttttaggtacacttaatggtatgggactatagattattgggattttctttggtttaaaattggcaaactatttttaaggggaagttgttaacaatcactttctacaatatgtgactctctcttcaaagagtaaatcagagacaaatcttttttttcaaatttctttttttgaaaatcaataataatgaccctattttttagtttgaatggattctcattaatttaaaatgcaaatattttggactaaatgtttgtgtccctcccaccccaaatttaaattttgaagccctaatccccagtattatggttttggagatgtgggcctttggaggtcaaaaggttgagatgaaaccatgaggatggagtcctcatgatggaattagtgaatttattataaaagacacagaagagcactttcttgtacacttcctttgtctctgtctctctgtgtgtttctctatctctcttccctttgggaacacaacaaaaggtatctgtgtgacaagcatgaagaataccctcagcagaaactgactatgtgtatgctgatcgtgtacttcttagcctccaaactatgcggaaaacattttgttgtataagacaccaagtttattgcattttattacggcagcctgagcagtctaacaagaaagcaataaaaagtataagtaattaagatgaaactaaatttatcatccaaattctcaccataaagaaataaccattttcaaaataggtagaacaagattttacatattttcctaaagtttatagacagagataattgataaagattttatacaaactgactattaagaaatgattgtatttaattataacagaagataaaaataattttgtatagagaaactgattaacgtttatgcatatttgttcctaaagtacattcaaagttaagagaacagattataaaatcataacttagagttcttatagtataggtttcttacaagaagggaagaaagcaaaataaatttaacacaactaaagcagatcttgcagaatgtgattcatatatggacatgagtcagcttcctaaacttgaatctcagtgttatatagatgaacccactcagacagaaacaacattgaactagaacagaactcctttgacaggcaatgcacatgtttttaggagagcagactgtaagctttctctgagcctcagagaggcagaaggtaagaatgattctggggtatgcatcctcaagtttttgtttaaactctctgaataagtacctcataccattttgccggggcaaagtgagtggatggggaaagcaggccaagggcattatgtgaatgggtcacttcaaagggaaaaacatatctgaaacatggtagaagcaccccataactaactactttttcatgcctttggcctattggacttaaccattatagcaatgatgactcaaaaactacattaaagcagtgttaagaggaacattgacggtgctaaatgcattcatcagggggacaaaaaggtctcaagttaatgacctaacatagcaactaggggaattagaaaaaaagcaacagaaaagacccaaccccaaagctagtagaagaaaaaaaataactgaagtcagagaactgaaaaaaaattgttatctaaaagtccacacaaaagatgaagccaagagttttttttaataaacaatactgatagatcattagctagattagcaaagaaaaagagaagatccaaataagtataatcagaaattataaagattatattaaaattgatcccatgaaaatacaaaagatatgcagagactattatgagcacctctctgcacacaaatctagaggaaatgaataaattcctggaaacacacaatctcccaagactgaatcaggaagaaagtgaaaacctgaacggaccaataggaagtttggaaatggaattagtaataaaaacctacgaaaaaaaataaaataaaagccccgtaacaggtggattcacagctgagttctatcagaggggcaagggagaaatgataccaatcctactgaaatgtctccaaaaaatcaaggaggaggggcttctatctaactcatactacaaagccagcattaccctgttaccaaatctggcatagaccacggaaaaagaaaagagaaaactacagatcaatatctctgatgaaaatacaagcaaaaattgtcaaaccaaatccagcagcacatcaaaaagttcattcactatgaccaagtagggtttattcctgggatataaagttgattcaacatatgcaaattgataaatgtgattcaccacataaacagaatcaaaaacaaaaaacataggatcatctcaatagatacagaacaagccatcaataaaattcaacattccagccaggcgcgggggctcacgcctgtaatcccagcacttcgggaggccgagacgggcggatcatgaggtcaggagatcgagaccacggtgaaaccccgtctctactaaaaatacaaaaaattagccgggcatggtggcgggcgcctgtagtcccagctactttggaggctgaggcaggagaatggcgtgaacccgggaggtggagcttgcagtgagctgagatctcgccactgcgctccagcctgggcaacagagtgagactccatctcaaaaataaataaataaataaataaatgaaattcaacgttccttttatgataaaaaccctcaacagattaggcattgaaggaacatacctcaaaataataaaactatctatgacaaacccacagtcgccatcaaactgaacagcaaaagctggaaccacacccctggagaactgagacacgacacggatgcccacttttaccacttctattcagcatagcactgaaagtcctagtgagagcaaacaggcaagagaaagaaacaaaagccatccaaataggaaaagaaattaaacaatctctctttgccaatgctgtgattctacacatagaaaaccctaaagtttccatcagaaggctctttgaactgacaagtgaattcagtaaagtttcaagaaataaaaacattgtaggaaaataagtagcatttttatgaaccaaaatcattgcagctaataaccaaatcaagaacacaatccaatttacaatagccacaaagaaaatgaaatacctaggaattcatccaaccaagggggtcaaagaccactacaaggagaagtacaagacactgttgaaagaaatcagagatgacacataaatggaaaaatatccatgctcatggattggaagaatcaatattgttaaaatggatatactgcctaaagcaatttacagattcaatgctattcctatcaaaataccaatgtcattttttaagtaattagaatgaaacctattataaaattcatctggaaccacaaaagagcttgaatagccaaagcaatcctaagcaaaaagaaaagccagaggtatcacattgccagacttcaaactgtactataaggctacagtgatcaaaacagcgtggtactgatacaaaaacagacacacagaccagtggaagagaatacagcacccagaactaaatttgcccacttacaactatgtgacctttgaagaagctgacaaaaacaagcaatggaaaaaaaatccctattcaataaattgtgctgtggtaactggctagccatatacagaagattgaaattggacccctgcctcttaacatagatgaaaattaactcaagatagattaaagatttacgagtaagacctaaaactataataatactagaagaaaatctaagaagtaccctttttgatataggctttggcaaatggatgactgagttcccgaaagcacttgcaacaaaaacaaaaattgacaggtgggatctaattaaactaaagagcttctgcctaccaaaggaaactatcaacagagtaaacagacaacttaaagaatgggagaaaatatttgcaaagtatgcttctcattaaggtctaatatccagcatctgtaaggaatttaaacaaatctacaagcaaaaaatccaaaaaatccacctaaaaaatgggcaaaggacatgaacagacatttctcaaaaggtgtcgtaacaagcagacaagaaacattaaaaattgctaaacttcactaatcatcacataaattcaaatgcaaaaaccacaatgaaataccgtctcacaccagtcagaatggcaattattaaaacttacaaaaaacaacagatgttgagaagtctgtggagaaatgggaacgcttatacattgtaggtgggaatggaaactagttcagccactgtggagagaagttttgagattcttcaaacaacttaaaatagaactaccatttgacccagcaatcccactattgagtatatatacccaagggaaaataatttattttatctaagagacacatgcacccgtatgttcattgcagcactattcacaataccaaagcaatagaattaacctaggtgtccatcaatagagaattgggtaaagaaaatatggtatgtatacatcacaaaaaacaatgcagccataaaaatgaacaaagtcatgttctttgtggcaacatgaatggagctggagaccattatcctaagtgacctaatagaagaacagaaagccacataccacatcttctcacttatagatggtagctaaacattgaatacacatgttaagatgggaacaatagacattggggaccactagattggggaggaaaggtaggggttgtgggctgaagaactacctgttgggtactgtgttactgcctgggtggtaggatcactgggactccaagcctcagcatcacacaattactcatgtaacagtctttcattaacctataataaaagttgaaattaattaaaaaaacaaaacaactacactgtttcattgctctagatttctttttgtctccatttaattatggagagacttgcagagacagaaatgactgtcacgtgttcttatacacataaagccctagaaacaggagccacagcacatcatgcactggggccatatggggaagtaccagagtcagtgaaggcaaaaggagcaagactaaagcatgagccagagcctttaatatggttttccttggaaggaatgagtgagacagtgtaagcagctgagcaggtttaagactgggtagtgtgagtactttttgtgtaatttagtccctagtgttccagcacctgattctggggtgacgaaagcagagggataatgtcccagaccacaggagccatataataagagtcaagtgagggtgtggattctggattggttggtttgcatataaataacatgatcataggcaagttgtttagtatttctagaaattagctaaccctaggaggagcactctgtcttgaaacccatatggtctcaagatgtcaaagcaaaacaaaaacaataaccatgattaatacagcaagatggaataagctatatattgccttaaggaagaagttacttggctctctatggctgatcgtcataacctgaaagatttgttctcttgacttgagctggacaactggggttttatttctgaagcattttataggaactactcattgttcttgtttttgtcatagtagtcatgatgctggccaattgcattcaactcagtcttaacttcctttttatagcagccctctcaccagaagatcgcccttactacaaaactgcaaaaagttcaagaacatctcataatatggttgacaatagagacaactaaacagtctctaagtcgtgaagatttgaatctctaaacttccctgaattggcttggtcaatgcctcacaagctagttaatgacaaaatgggaggaggggtagccagaccatatataagaatagagttctgacccacatctttgtagcaaccagcctgggaagccaaaccacagcctctgcatcaaccagccccaaatgaataggatttagttaatgattgccaggttccctatttttgcccccgctgccaactcaggacccatcagagaaagtcaagtatgctttctgactgatcacataagatgctccatttccccttatttatttagtccatcttcagcttccccatacaaccttaaggcagagcatatccaaaagctttccttttccaggtacaaaactttcctattcctcagcctttctttgagtctctgcaaaacatatatgatgacagctgactttcttgttataaaaagtctgaataaatatagattctctctgttattattaggtgttatttatttccacaatctacaaaaaatcttcaggcagggtactatttaaaggtgcaatattgaaaaattccacataaaatcaggaaaaaagaaataatgttcatctcactactgttcttctacacattactgtaagcactaaccattataaaaagaagaaaaataaagggcataatgatcgaataggaaaaacaaaattgtctttacttgaaaatgagatgattatggaaaaaaacctaaggaatacatttcaaaagctactagaactaaataatatatatatatatatatatgaaatttatagcaaacaaggttaatatatgaaagtgcatgttgagtgttccttatccagatatctgaaatctgaaatgctctaaaagctgaaactttttgagagctgacgtgatgctcaaggaaatgttcacttaagaattacagattttggatttctggattagcactactgaatttgtaagtataatgtaaatattctgaaatctgaaaataatttgaaatctgaaatacctctggtcccaagcattttttaactcactatatgtgctcatttttttttaacaaatacctattaagcagacactatgaacaaaaactgtgcaaacattggaaatacataagtaagcaaggcagaagggcctcttgtattaaaaataaacgaaggaggacactagttaaagtggtaaggacagattttaatcagtaataatgattgcaacagggaaaagagtgcagcatgagttgaattcaacttcaatttgtatattggcaactgattgttttattttattttagattctaggggtacatctgaacgtttgtcacatgggtatactgtgtgatgctgaatattggacttctaatgatctcatcacctatgtagtgaacataagacccaatagatagtttttcaacagttggccagctccctctctcttcccttttggaatctccagtgtttatggttcccatctttgtgtttttgggtaccaaatgtttacctcctacttataagtgaaaacgtggtatttagtttgctgtttttgcattaattcgacaagcattttggataagcagttcttaaccggtaaaatgtgttgttgcatactaataatgaatcattaaaacataataataaattctattcacaatagaataatcacaagcatataattcttaggaataaaggcaacaaaatatgcgtaggtcttttatctagaagctaaaaaatattattgagaaattttaagaaaaaatagaaaacgtagatctatacatgttcttattgatatgttatttatattaagatatccatccaccttatattgatctacaaatgtatttcaactctgatgaaaatcacatcagattttactgcaaaataaaaataaacaatgtgatgtcaagatgtatataaatatgcagaaagacaaaggaacataggtaacttaaccaatcttggaaaagaatataatcaaagaagtaacattaaattattttaagatttttaaagctgcatgttaaaaaatggagcatccataaatatgtttatgtttaacatagatgatgaactgattttctatgaagacaaaggacaatagaaaacacatatttttacaacatatctgaaacaactagataaatttatgaaaatcaaattaatttttttatttctaactttttctgttgcccaggctggagtggtgcaatcatagctcactgcagcctcgaactcctgggctcaagaaatcctccttcttcagtctcctaatgcactggggttacaaatgtgagtcatcatgcttagcctaacgtcaatgtttatcccatatcatttacaaatttgcgatgaatccaatttgagatgctcataaacataaatatgaaacataaatataaaaactaatactataaagcatataagagaacaatcttgcatcttagggggcaaaatattacatctttagggaggcaaaaatatttcagacaaaacaaacagaaaatgtagccataaaggaaaaaattatataaatagggcttcctcaaaataagattttctactcatcaagagaaagcattgaaaaaaattaaaaggcaggacacagaatcagaggaattatttttaatacatacaaatgacttagaagatcttaataagtagtactattcagtaataaaatgtctaacagcctctccccaaataggcatgggtcttgaatatcttacaaaggaagatatgcaatgtcacatgaacaggcactggacatcattattcattaggaatatgcaaatatacatgacaatgacagccattgcacattcactagaaattatttaaagaaattttaaaatactgacaataccaaaaattatagatatgtagcaactggaagtctttttgtttcttaagagtgtaaaatggggcaaacactccagagaacagttaattattttcttataaagtttaaaatatatttttctttgacccagtaagttttttctctgttacgtatacaaaagaaataataactgatgccacgataaagatttattcaaaacttattagaacagttttattcttaaaactaaaccttgaaacgacccaaacaaccttcaataaaggaatggatacacgaattgtatatattcatacagtggacactacagtactcagaattaacaacaacaacaacaaatcagatattgacgtgtaacaaaatgtctgggcctctataaaatattatattgaatgaaataaaaaagttgaatatctattcttactatgttgaacaaattaaaaaaaattacatggcataaagttccatttatatgacattccagaagaggcaaaactaatccatggttatgaaaataagaatggattaaagatttgatgtgtgagtgagatttaagtggaaaggcatgaaggaatttttgaggtgaggaaaatgcctgtagcttgaatcggtattgattatatgggtctttgtatttgtccaaagttattgaattgtaaactttagatctgtgcatttcacagtttaaaaaaatttacctcaccagtgaaactctgtctacctaaagtctgcagaaagcataactcaagaatttaacataaggtcccctaatcacatgaaggtaagaaacagccatcttttaaacatttaaaaagtcaggggaataaaaaatccagtttttttttttttgaataactattaaacttatgccagtgaaagaaaataaaattaattttcacaaaagttgatacacatgactgaggattaaatctatattgatattgttgagattaaaatacaacgcaattttaataaacatttaaaacacggacatggtgtccctaacaatttgttgataggggagaggataatataaaaattaattttatgaatcccacataagtacttgttaaaaacatatgcctctgttctttttatttaggaatcactcacagaaagcacacattctttgcttctgcactaactctggaattcaatattagaaggctcaactgccatgaatataaatcaaattcatctgcatcccctatatcagactaaatgtgtttgtttctcagtattctgctatattccttgtattaattttaatagaatcaaaactgagatatggaagaggatgttatatattgaacatcttttcttccatctagcatacccaatatttgctgcatgggccagaaatatgagaattagaaatgcgtctttatttggggtccttacttcattcacaattctagatagtcttctagttatgacaaagtctaagaattttatttttaaataaattattatcatatttttctgttaccattttttggttggttttccatgcagtttgtgcctacttccaggaggaagacacctacacacatttactcttctctgctttctttacaaatttgaatatgaaaaagagagccaggaattgccaaaagctggttactccaagaccctaggcattctgtcaaaatctaacttggatgatcatgtaaaatacttatcattttattaatatcagtatgttcattcaaatggtaacaagattttcacttgatttctaaatcactgatcttaagtgaaaaatatcaaaatagaggacttcacaaatattatcatttagaacatcctcactttaaacaacctaaagttatttttaatgttgaatcaatcatactctgaccttctccataggaaaggaaaatgtaaatatcccagacagcagagagcaaactgtcataaaaataaaactgtactttcaaatagctgtagtccacagcacagctctaacccaaattgtcatttcaactgcttcacattattagaaaatacttaccttctagctttgaacatgaaagaaaagtactcttagtctatcagtttccctaactaggagattcatgtatttgttggggtcatataaagaaactgatagtgcaatttaataaggataatgcagagaggatttggagactctttgcaaagctgttgaagggatgagaaagaacacaagagactgcagtaacctttggttagagtgatttttatcacccctagtttgaaagggccagtggcaaagcaagtttactaactttaggataaagtagactcatcaggaaaagagcaaccacctaagcttaagggacaaagccaatcacccctgggaagccagtgttaaaaatacttgatcttgctctctgctttcctgagaatacaaatcattcactttaactcattgaattcactcagcagtcagaagaaaaggaagcctcttgttggaattcatactaagaagatcagaaagtgtagtggaaaagagaggactagaactgcaggtgcaagtagaagtcagtgtccaaaaagaagtgtatttgtattgttcatttgacctcatttattttagtatgcaagcgtatgcttaaaaatatttcagccttctttttactatatatgcaattcgtcattatttattaagagattatatattcatcattacttcaatgatctcatttttagctttcctcttctttattaatggatgcagtaacttctggcattcccctgagaatattaattctacttatttggaagtactctttttattgctctctgctgtctttcttttgtattttatacatctttcatttgctttatgttattttaatcttaccctatgcacttacaatgatggcacttctccgaatgactgttgattttcttcctttctttctttttttcatgttgtctacatttttttttcaaggtgagtttctgctagactgttattactgagcaatcctttggtggagaaggaggttcatgctgctacaggccacaatttgcctcatttgcagtcagatcaggctttttttttttttttttttattatactctaagttttagggtacatgtgcacattgtgcaggttagttacatatgtatacatgtgccatgctggtgcgctgcacccactaacgtgtcatctagcattaggtatatctcccaatgctatccctcccccctcccccgaccccaccacagtccccagagtgtgatataccccttcctgtgtccatgtgatctcattgttcaattcccacctatgagtgagaatatgcggtgtttggttttttgttctatcgcaagatcaggctttttgtcagagagaggacatgcccattaggcaagatgtattcagatatttccaactgatcgctgccttttctttctgattcaaattcccattctcaatatatttacctaatgtatgcctccattttgcctttttaagcaagactaaaaaatcaatacccttggaaaaaattgattaatttggctaacttaaatttaaagtcttcacttctagcaaaatagttttactacatattttttactatgagaaaatatgtaaactatgtatacgaaagcaaatctataaataatttagaaaaataaaaatatttcaatagaaaagtgggaaaatgtaaaaataggtacttactggaagaatcaagagattagttctaaagaccttaattatttatttaaactaatttaattaaaattttaaaaataattaaatttttcaataatcaagtaaaacaaattaaacttaaacaatagaaccttttattttgagatgcaaaagcatgaatcaaagacatctgtaaagcttaaatgtattcagattgtaaagctaacccatgtaaaccaaactaggccaggaattagactatattagcgccccagactcccccaagtgtcccttcctaaaagaagctcctctcaccctaagttttatgtataatttttttgctgtgcttcaaaaaggtatagcatgtatgcatctctgaacaacataccttagtgttttttggcctgctttgataattactatgaaatcctctttctgtattattttgtgccacactccttttgttcaacatatgtttatgagtgacagccctgttgttgcaagcagttgtaatttattttttttcactgctctataatatttgattgtttatatagatgagaattttctattttattccttatatacatttgtgttattttaaagtttggttgcttaggagcaaagtcaatatgaaaatacttggacatatgctctcagaattatatgcataagtttatctacaacatataactatccaaggaattttaggagcaaacatatgtggttacttatttaatcacagactaactttttttcaaatcagttgtatcaatttatacttcttcctgtggtacctaagatttcataaaattatactttcaatccatgggcttagcaaaataattcaaagtttaataatatcaaattgacatctgtaatttaagaccactttagatgaaaatttttgatatctattaaattttacaatgtgaataacttataagcacaattttccttaactcatcatctgtcttatgaaatactaacatatgtgcagtaaaatgcaataggatgtcaattacagctttttaaaaatagtcaaaagcccattaaatagattaaatgtccaccaatagagaaatggctaagtaaatatgacatatctaagagttaaagaaatgataaagattaacgtgtgttgaatcactaagatttccaatacatattaaattgaaaaataaaaacacattattgtggttacaaatacacaaagtattagattatcaaatcagactcacatgcatcggagatcttatgcaaacttaactaataattttatggataaaaattattgtgaggtacaggtggagcaaggtaaggtcagatagcactgtgagaatccctgggtcctttccttccacatcagatatgctttgaacaaggataatagatgatgattctgagtaagatgtgcggtcatctcacttacacagaggagatatttagatcacaaaatatctcattttgtctttagatggtccaggaaactacgccccatgagtcaaagagatttaggttttattataaacaaccctagaaaagaaatcacagcacatacattcttctaaaagcattctgtaggtaaggtattccttcctggaaacttcttagtttgtttgccaagaggttagccagttatatggttaccaaaaaacctgccttctttgtctcctgcatgtttcttattaaagagaatgaatgaattgcagaactattgtttgcacatttacttttaaatggtttatcagtaaaatatgtgagaatacatttttaaaataaacttatgtgattgctttggaaaatgtctggaaatacgcaaaccacactgataataatggccttctggggatgaaccaacacacaatagatttactggtaatcgtttgattttttcaaaagtactacgttcctgtataatttgcatgattaaaatgtatttaatataatttccacctgtgataattttcttgtgtataaataggacattgctcttgctattagcagctatatactgtaatatttatagttgaaccacagggtttagcagacttcagcccatacactgaacctgtcctattgcctgtttttgtacaacctgcagctaagaatgtttttatattttttgaataatacaaaaatatcaacagaataatagttcgtaaaacaaaattaacaaaatttaacatttgtgtctatgaataaagttgataatattgtaaccacagccatttgtttgcatattgtctactttcttgttacaacagggtttagcagttgtgacagagacttctacaatgtttccaaagcctaaaatatttactgtcttaccctttatagaaataaatactttgctgacactgtgactcataataatgtttgcaactactttttgaataagctcaaaagtttacagacacacactcctaaaatatttgttatattgctctttatagaaataatttgcttatccctgtgaattatagtgatgtatacaactgatttttgaataagttaaaaaatttagctggggcggtggctcacacctgtaatcccagcactttgggaggctgaggcgggcagatcacctgaggtcgggagttcaagaccagcctgaccaatgtggagaaacccagtctctactaaaaatacaaaattagctgggtgtggtggcgcatgcctgtaatctcagctactcgggaggctgaggcaggagaatcacttgaacctgggaggcggaggttacagtgagccgagattgcaccattgcactccagcctgggcaacaagagcgaaactcagtctcaaaaaaaaaaaaactttacacacacacacacaaacatggattatggattgagttgcatgtatttgaatattagttttgttattcttgcaacttattaggaggtttgacactttttctaaattacaattgggtgaaatttttgcaattgataaattgctagataacataatctagctcatattatatgataactttagatgttaaatcagcaataaaccttatgaagatctatgtttctaggaaataattacttcaacaagaagggaaagtaaagacagaaggtaaaacaaaatataagacgaaataaaataaagatgggaattgaatgccatagaagtgtggaagttggagggaaagtttctaaaattatttggataaaaaggaagccatatattttactgaatcttctagatgggttttaattctgtatcctttcatactcacatactatgccatttttttcaacttttcattccacttgcacttcctaacttatgatgaatttacctatatagagtccttttatcatttagactaaaattgtatttatttgaaggtaagaacggtcatatacttcttagttgttttcagaattgaaaacatggttgaggccaggcacggtgtctctcatctgtaatcctagcactttgagaggccgaggcggggggactacgagatcaggagttcaataccagcctgaccaacatggagaaacgcggtctctactaaaattacaaaattagctgggcatggtagtgcacacctgtaatcccagctatttgggaggctgagtaaggagaatcgcttgaaccctggaggcagaggttgcagtgagccgagatcacgccattgcactccagcctaggcaacaagagcaaaactcatctcaaaagaaaaaaaaaaaagaaaaaagaaaacatggttgaaagtcaatatccatgtgataaattgagttagaaagccaatgagagcttagctaatataaaggtgatggaattcactatcaaaacttttcagagacttagaaaaaatatggaaaattagtgaaaatgtaagagaatgaagctcgaaatcaagataattaaactgcaaactttaagaaggcaggaaagatatcctttacttagtttgtcttgtccaactaatggttagttgaatgccatgcacataacacatccctctgagtacttattgaataaatgtagaatgtcattctggaataaattgaggcaagaaactagagggatagcagtgtgaaaagtgagattaatttatttggtatagagtcagtaaatttaagtgggtcatttgaaacaacaagcttaaaagaaaaccaaataagcattttcaatgcatagaaatgcaaccatttttctccttctgtactttatccattcaaacattgcttgaaaaaaaatataactttcagtcttgcttttttatctccaccaaactcagataattttggtcgttgatgacctttctaagctaattcctattttagaatgctatggacgaatgaatctcaaaacttcttttaaccaatttattttattccatttcctaaggaatagaaactttttacctccaacccaggggagctatgaaacaaactccccatttatttccaatccaaacacatttgataaaacaggcagaggaattttttatcagatctgtattttaaattttcatgactgttgttcaagagtttccattcttgctcataaatatgtagaggcttaaaattcttttctgaaaaataaactgctactttaaatgattttaactcatttttataatactttttttattctctgatgatctcttgctgtttttctttctctagaaatgttctaagaataaattagctgatatagtaagaaaggttcacaaaatgagtccttcacttatacagcacctcttctaaataacagagagattacaaatccaatgtatttaaactctgagttgtctatatgtgtagtgttataaaatgtagctgtcagttttaacagcttttccccctgagatttcagtggctagctaatgatcttttttaagaattaggacattttctagatagcgaaatggcaggaaaacatatcaaatacatatttttccattatagtattctgaggactgtaaagtcttactcaatgtatatcacttttaatttttaggatacatagaaatatttgctagtagaaataaatggcaagtgtttacttgaagatggtttagaaagatgcttttctcttttaatttgaattgctactgtaaatgtcatcacatgtatttcagtattgtctatgccaactttgtacctgaaaaacagtattatgaattaggcattatattccatcttcataaattaaaaaagaaacataataactagcgaagtggaatgaggaaggtgtggggagacacagaaattttcaaaagtagtaacaaattcaagcatgtattagcttaatatatcataacttaaatgatttaaattaggtatatgtttataccaataagttttaaattcttaattcttacctcatcaagtaccaacaaagaatgcccttccatattaatacactttgggaattaagataaagtatatgtaattaaatcatcaaactccttttgttgtttagcaggtagtttgatataataagagaaattgtgttctcattatatatttgtcacaatgaatgaatgtaaaaccttaatcaggctatctgacttcttttagtgacatttccctttttgcaaccaacacatcaaattagtaatatttatcctacaaaaataatgtgaagataaatgagataagatatataatagtcacaaatacttattgaataaagctgtttttatttatatatttctatgtacttactagatatgttcttattaaatattttattatggtatatgtcaagtcttttactttttttatacttagtgtattatagaactcaccatccaataaaattgtaatacaattttcttgatttactaatcctaggtgaaaaaaaaaaatatatatatatatatatgttgttttctgtttgaattatgcttagttgatggcattttcaataatctctctgattcttccttttcctgtttaaactactctcattctcattgtggcctagagttctttttccctaatattgccttcagaaggctaagtttctaatataataacaatttgagtctttaccacttctctctagaatcgtgatttagactaggttattagagtaaacaatatgattccaaattttgtcctttttttaatgggctagcatccaaaaagcataagaattctggggggaaatgacataattaagctagattattttaatttaaattcagaattaaaaatgattttcaatagcttctttgtcttaatttaataagcttttgttgaacattgattatattttgaattctattttttcttttgtttttagttggcacataattatacatatttatgggatacagagtgatattttgatacatgtatacaatatgaaatattctaatcagagtaattagcatactatcaccttgtacatttgtcatttccttgtgatgtgaatattcagaattctatctggtaggtttttaaaaaaattcactgaattattgttaacttaattcaccctacagtgctacagaacgctagagctattcctcccttctagctacaactttgttacaaagttaactttgcttaccaacctctttccatcctcttcttattcccatcctttccagcctctgataattacaattctacttgttacttttataagctcatttttagctcccacatataagtgagaacatgtggtttttctctctctgtgcctgtcttatttcacttaacataatgtcctccaggctcatctacgttgtaactaataacatgatttcaattcactacaaaagttaaaaggatactcaacagtgccaaacattctattttagtttcccaatgcattcactcccacagcattcataacaataaccttctacaaagttaccacatgtcttatgctaaattgatgagatctcccaatattaagtaaattctgtcccttagctctccctctcattttagtattatcattctcattaatgaataattccctttttgttaaaagtttacattgacctaccgttgtccttcagttatcaacttactttgtattctttctttgaaagaaatcaatcaaacaatagacagtctccttcaatatttcctgtactgtcttcaatccacttagctgagtactttcttttttctctacttactcactttttcccctgagtgttctcaagcattttcatgagtttaaaggccagttacatgatagcatctcagaatatttccaattttggtatcttctctgagttagagctttgcatagtcatctacttacttaatatcaaatgtggattgttttatagacaactgaaattcataatgttttaagtagagttttgttattttctctgcttcccagtttgtgtgtgtatgcttgtttgtttacttcagctggtgttcccattgattttatcttatctaatacaccaaaaccctatcagtggctcttttcttcaaacttgcacatatcttaaatatgtatttcattattttgaacaaggtctccaccttcttgtcgtttcactttaatagttttctaattcatttccttgtgtttattcttgtccctgtaaaaattattcttggtttaagaggcagagatatatatgtattataaacacagggaaacaaattagatataaaccaattactataaaccaatgtaataataataatatatattacttttttctatttttttatttcttctttttcttttttattttttgtaatgtaagcaagattctttccctcctctgccttaaatcctttagttacttgtggagtacaattacaaatctccaggatgctaaagctctgctctgctgtctacaaccacaggcaccattcaagaccctcactcctaatgagacagggctctttccactcttgaaacacagtttttccccatggcagggttttgcacaaggtaacatcttgtctttgaagcttcatagtttggctttttaatcaaatggttccttttccatatttaagtcatcactttacatttcattttctttttttttttttttttttttttttttttgagacggagtctcgctctgtcacccaggctggagtgcagtggcgcaatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggccttacatttcattttcttggagaggtcttcacatgactccaagctatcaccagttatgtgctatcgtagaacatggtttatccagaaatagtgataactttaatcactattgatcattctttggttttctttacatttattttatatcttaaacactgtaatataaaagacctcagggatggaccatgaatttcatatttagcacaatacttcagaagatccatcctatcctttttcttttttattcattttattttaaaattttcattttgaactactttaaagcttacaaaaatatattttaaaaaatcaagaattcctatatattcttcacccagcttcttgactgctaacaccatatctaagagtacagttactcacattaggaaattgatacggaattagttacttacctacagaccttatttacatattttgttcatggttccactaatgttttttaactaggatcaaaatcagggtcacatattgcatttatctgctacatttctttagttttctttattcgggtgcggaggctcatgcctgtaatcccagcactttgggaggccgaggcgggcggatcatgaggacaggagatggagaccatcctagctaaaacggtgaaaccccgtctctactaaaaatacaaaaaattagctggcgtggtggcgggcacctgtagtcccagctacttgggaggctgaggcaggaaaatggcgtgaacccaggaggcggagctttcagtgagcagagatcacgcctctgcactccagccttggcaacagtgcaagactccatctcaaaaaaaaaaaagttaaaaaagaaaattcagcttttctttttgtctttcatgcccttgatacttgttttttgtagattattttgaagtttgatttttttctaatatttcttcatggttaaattcacataatatattttggcaagaatgccacaatgccgaggttgtccttctcagtgcatcatatcaggaggcacatgatattatcgtgtcctaatattgttgacgttaactctgatcacttgaataagacattgtctgccacatttctccacttcaaagttaccatttttaaaatcagtattttgttgagagatacttggagattatgtaaatatcttgtttctcataattgtatccactaattttagcagacttgtctgcaacaattatgtggtatttgccaagaaatgagaatctatttccactattctttctatatttattgattagaattctactgtatggaaaagctttcctttgtcccacttttcttatttatccaattatttatttatattagtgtggattcatgtgtatttggtttaattaatctgaataatctattgccatcattatttattcccttgttcaatttatctcagtttgggtcactgagagccacttctagttagctcctatgttctttggcatgtctcaatcattagttgagacttccttattttcttaacaacaacagatgtctcagacccattttgttctttctgccgcatgcacctagaatcaggcattgatccaaggagctctgtatccttttaaagaagaaaaaagtgaatccaagatttgaatgctagatgtgctgattgctattaaaatgttattgcttctagtcttagtggttaaaattaagaaatatacacacattcggccgggcgctatggctcacacctgtaatcccagcactttggaaggctgagatgggcggattatgaggtcagaagatcaagaccatcctggctaacacggtgaaaccccgtctctattaaaaatacaaaaaaattagctgggcgtggtggcaggtgcctgtagtcccagctacttgggagactgaggcaggagaatggcatgaatccaggaggcagagcttgcagtgagccgacattgggccactgcactccaagctgggcgacagagaaagacttcatctcaaaaataaaaatatatatatatatacacattcacacacaaacatgtgcgtctaggtctatttatatatctacacattcttttcaatttctatctaacgtagaaaaaaagtaaacttaagtatatattgatagttttgattctgattgaacaccataagtgttattctagtctccactccccctcatttctaaattctttttctaaaacggaatcagttttgttttagttaatatacttaatataattatttgctttttattttttttttaaatttcaacttttagatttgaggatatatgtgagtgtttgttacagagtatactgcatgatgctgaggtttgggtatgactgaacccatcatccaggtagtgagcatagaacccaagaggtattttctatggcactttacacattctagaaaactggttgttaattagcacaagcacctataatagtgcctgatatatttagtactcaaaatatatgttaaattaaaaacaaatgtataaattaatggttgaatatcataataattactcaaaatgtaacataattccaaaggagaaaacttttttctaaaaaggctctctcaattgctctttctgatttactattttccccaatctgtagttgcttcattattgtttggaattttgcattagttgtcaataaacaaaaaatatggatcatatcacagctctttcattgctttcatttcttgagatatatgaatgtatgtgatatctttgatgtcctgtattttatctttattgctttttgttacttaagaacatctagaaaagaagataaatattaatcatgtcagaaattatcaaaggttgattacaataaaaatttctctaatgtgataaccactcaaaacttccttcttcatcaaaacacagtattttttaaaaaatggagtgctgcatttttatttcacagaaaataatcaaatgatagccagaatattttgaactagagtcacataggatattctaataatactgcttgtgaaagaagtattgaggaggtcttaggaccaaagaatatttgtttaatagtgtcagaattcattttaacaccataaaaaggatatgtatttgttcaattttcactcactgcacaaagaattagataaaagaagattttcagtaatagcattcattttgagtcttaccaatcctttcagttttggtataacaaaaatgctattagcttttactctgttgtgttgaattttgatgatttctgacagtcttcactgagatgctcaaagagatgagacttgccagtcgaaaaacttaagatctcattaaatttaccagcaacataaaagctatttctgcctcttaactttttgatgtgttgcctttttctagtcctcttctcaggacctatttaaaagacaataaaaattttgtttttgtgtgttgaaagatttctccattatcaagagagtagtccttaactttagaatgactgcatatatagatatgaaaaataaggaaacaattattaagaaaactaatcgaattttttactaatatttagtaattttaacaaaattattgtgcattgtattttgtagcatttatgcagaggatatactaacctgtttaaatttttagacaaaaatagtagaaaatagaacatcgtcattttcaggagcaaggaagtaacctgtgaaaaagtgaatgcctttcttcaaataatatgctaatgaaaggctgagatattaatgtctaaatattataaaactttcattttaatataatgttttactttatatttatattatattgtataacaaagaaatgtgagtcttgttacacctgagaacttgaactggcaatctacatattgttgttgaaacaattttaagttaaacatacaatgagagggaaaaatgattctgttgcctcaattttaaaaggaatattttgaagaaccaattttccatataatagcttgttatgatcttgccttttagcctccctggataaagaaatgcatacttataataattgaaggaagacaattttccttgttttctgcaaattagaaatatattaggctattaaatacataattcaaaatatacagaataaaggtattatagaacctaagaattatataaagaattatatacataaagtaatgaatacatatacaaatagtataaaaatactaaaaatagtatttgcttattgattaattactatgggtattatataactcttagtttctacattgcttttctattcttagttattataataggtatattataattactaatatgtataaactacttatagtttatatgaatgtgttatatgtacatgtatattataataactaatacctataaactatttacaattatatgtattataataactaataaatataaactacttattgtcaaaactgtttttaactattaaaagataaagcacacagatatgttttctttactaggtattcccagaagcactcataaaactcggggttttcatatagcagtgattacagacttgatatttttattattcccattttatagattaagagcacaagacccatattagtgttatttagccatgtcatagagccaattcccagatattttttccacttgttttgtcatgaagaatgagaagtagaatcagcatcaagtttgtgctaaacaagtacaataataagaagcacagcaaatgctgactagactgtaagaatatttttgcttttaggccacccgaaaaagataagatatatgaggtgatcaaagtgaataattatataaacaagaggaattagaatatgaataagccaggaaaaataggaataggccaagaaaacacacacacccatttcttatttaaacctaaagggagacaaattcattcaatctatacatatttattttgctacctcaatagagataaatatcttctctaagaaaaatcccactttacttaatatgtatcacatttacctaataaataacacattactaaaacagagagcaaccagtgttttactcttttttttttcagagatgttttgctcttgttgcccaagttggagtgcaatggcatgatcccaactcactgcaacctccacctcccaggttcaagcaattctcctgcctcagcctgccaagcagctgggcttacaggcatgcaccaacatgcctggctaatttttgtggttttttttagtagacacgggatttcaccatgtcggtcaggctagtctcgaacacctgacctcaagtgatccacccgcctcggcctcccaaagtgctgggattataggcatgagcctttgcgcctgacctcatttattttcatataaaatatagggtcaagtatgttgagatattagttacgttatattttgctcagtattgcctgagagttggattattttatcattgtagagaatagcttctagattatgagaatattaaataaaataaactggagagactctcagcagcaaactatggtatgtaagtacatatgtaaatatgtatctatctatctatctatctaatctatcctatctatctatctatcatctatctatccatctatctatctatctccttttctttcatttatgtctggatctgtaccaaacaccaggcagaggagttaggagaagtaactgaaaaacccatgggtgacatcaccaactaaaacaggtgacaaataatcagcatgaaacccagaatacaagagtaattgtcctaatcactggcagcatagggccagtaccagctggagttaatggcaaagataaaatgaagataaaaggaagtattgtaagatcttaatatcaataaactacaacaagaaatcatcaataatgctcactcgcaaaagaaaaatacttaccctgaagaaaaacaattggaacaaaatcaaaattaatcagagaatcagataatctgagacaagtaagataatttttagaaaataatttttagaaaaaaataatttgaaggtacataaaatcaaatagaagtggtacaaactatagtaagagatatagagtataaaaataagagtaaaaaacagaaattgagagattaaaaacatctaaaaattttctaaacataaaacttaggcaaagaatagtaatacccgtgtaatggttatttctaagaacaaaaattaaaataaaaaataatattaattatttgagcatgaaggtaaaaggataagaagtttatattgataatagacttcttgatagcaatattttatacaggatgataatcaagaaatggtttaatgattatgaaacagataacacagtagcgagatgagattttattcatccaaactatgaatcatgtctaaggaatgtagaacatcatgaatatttatgattttaaaaaacattgttcctgtgatggcttttttagaaatgtcctacctactgacaagaagacaaacatcatgtgaagcttctggataaggactaaatatgtttaattttataattaagagcaagtaatggggattaaagtgacaaaacatgatgctattaagtgtgttaaacatgaagaaataatgcaactcaacaacaaacagaaaaaaggagaagaaaaagaaagtagacgaatcttaatgactatctcgggagtatctaactgccattaaaaaatatggaattaaagtaaataaatgttaagccaaaagagagaagaaaggaaagagagtttactagagaacagtattactactcattgaagaaaacaatagatagtattcaaacacactagaggactagtatattttattataatattattataagataataataagaataaacatagaaacatttataaataccagatgagtatatcctgcgcctcaaattaaagtgtaaatacagggcaagattttatataaattatttatatagcaaaaacttatataacagaacttaacaccagcataacaggtatatcaaagacacaaatgggcttaactcaccattaaatggcgtacttttagattggctaatggagcagaatccaatctattctgtgtgcaagaaacatattgaacaaggcaattcagaatggtttaatgtaaaaggaagagcaaagatagatcttgtatgatagcaagatcctgaaatagttgtcagaattttgctatgagacaagatagaatttaagacaaaataaatttaacaggataaggaagggaaatttattctacagaaggattcatgcttcattctacattaaaaataaaatatatattaataacatacacaaaattacaattttcataaagcagaaataacagaagttgaaggaagaaatagacattacaactggagattttaacatagcttattaattggtaagtccttgaagaatgcaaataagcctcacttttagtaattaaaaaaaattaacacaaatactgacaaagactctctccttcatcaaactttagtcagatttttgagctctcctctcaactagatcttcatctaggccccttgcctagtctccatagctcacttttaacaagaatccttaagtccatatagagagaatcttgatatctgatcaccctgagctgccttcagcaagaatcctgttaatttggtttagcaagagttcccctacttttgacgtctcctcttaataattttccatccactgaccccttcacactgctcctttgctacaaatttccatgtgtgcttgtatttggaattgagctcatttctctactaaagtctcttttcctgttttgcagtaatttctgaataaaatcttctttactgctttaattatcctctggctctggttctccttgacattactctttgaagaatcactttaggggaaaagaataaatgcaaaaagacaaagtcagagactattatccgaatatagaatggagataatgatatcatactgaatgggcaaaaactggaagcattccctttgaaaacaggcacaagacagggatgccctctctcaccactcatattcaacatagcgttggaagttctggccagggtaattaggcaggggaaggaaataaagggtattcaattaggaaaagaggaagtcaaattgtccctgtttgcagacgacatgattgtatatctagaaaaccccattgtctcagcccaaaatctccttaagctgataagcaacttcagcaaagtctcaggatacaaaatcaatgtacaaaaatcacaagcattcttatacaccaataacagacagacagagagccaaatcatgagtgaactcccgttcacaattgcttcaaagagaataaaatacccaggaatccaacttacaagggatgtgaaggacctcttcaaggagaactacaaaccactgctcaatgaaataaaagaggatacaaacaaatggaagaacattccatgctcatgggtaggaagaatcaatatcgtgaaaatggccatactacccaaggtaatttacagattcaatgccatccccatcaagctaccaatgactttcttcacacaattggaaaaaactactttaaagttcatatggaaccaaaaaagagcccgcatcgccaagtcaatcctaagccaaaagaacaaagctggaggcatcacactacctgacttcaaactatactacaaggctacagtaaccaaaacagcatggtactggtaccaaaacagatatatagatcaatggaacagaacagagccctcagaaataacgccgcatatctacaactatctgatctttgacaaacctgagaaaaacaagcattggggaaaggattccctatttaataaatggtactgggaaaactggctagccatatgtagagagctgaaactggatctcttctttacaccttatacaaaaattaaatcaagatggattaaagacttaaacgttagacctaaaaccataaaaaccgtagaagaaaacctaggcattaccattcaggacataggcatgggcaaggacttcatgtgtaaaacaccaaaagcaatggcaacaaaatccaaaattgacaaatgggatctaattaaactaaggagcttctgcacagcaaaagaaactaccatcagagtgaacaggcaacctacagaatgggagaaaattttcgcaacctactcatctgtcaaagggccaatatccagaatctacagtgaactcaaacaaatttacaagaaaaaaacaaacaaccccatcaaaaagtgggcaaaggatatgaacagacacttctcaaaagaagacatttatgcagccaaaaaacacatgaaaaaatgctcaccatcactggccatcagagaaatgcaaatcaaaaccacaatgagataccatctcacaccagttagaatggcaatcattaaaaagccaggaaacaacaggtgctggagaggatgtggagaaatagggacacttttacactgctggtgggactgtcaactagttcaaccattgtggaagtcagtgtggcgattcctcagggatctagaactagaaataccatttgacccagccatcccattactgggtatatacccaaagaactataaatcatgctgctatgaagacacatgcacacgtatgtttattgcggcactattcacaatagcaaagacttggaaccaacccaaatgtccaacaatgatagactggattaagaaaatgtggcacatatacaccatggaatactatgcagccataaaaaatgatgagttcatgtcctttgtagggacgtggatgaaattggaaatcatcattctcagtaaactatcgcaagaacaaaaaaccaaacaccgcatattctcacttatacgtgggaattgaacaatgagaacacatggacacaggaaggggaacatcacactctggggactgttgtggggtggggggaggggggagggatagctttaggagatacacctaatgctaattgatgagttaatgggtgcagcacaccagcatggcacatgtatacatatgtaactaacctgtacattgtgcacatgtaccctaaaacttaaagtataataataataaaaaaaaaggaatggagataatgatgacgatgatgtcttggatagtgattgcaatggactgcatggctgttgccaccctgtctctgaaacttataggtggaaatcctaacccttaatatgatggtattaggaggtgggactttcaggaggtggttacatcatgaggttggagcccttctaaatggaactagttcccctatataatagacccaagagagttctctcactctctgacatgtgaggatacaagaagaaaatggtagtctgcaacttagaagagagatatcactgaaacctggtcactctggtaccatggtctcagacttctagcctttagaactgtgaaaaaattgatatttgttatttctaagccacctagtctataggtctttgtgatagcagtcagaattgactaaaacagtaatagtagcaatggcaatggaaagagtgaatgcatttgatatatactttgaagaaagaaataacaggactatcagtcatgtggacgtttggcatgagagaaatgcaagatggtagttaaacaaatttgtgtctaagtctgaaggttgaagaatagtcaaaggtaaaagtaaagctatgggagttaccgacacttatgagccttttaaaggaattatttatttttattgttaaatcaccaaggaagggttgaaacagacaatagaaattaatgccaaatgagctgaaaaaaaaatgtattgcaattgagttgggaataaaaagctgaggtggcaagaagaaaagcaaggttggcatatttttaacgaactctataatgaataatgttttgaagaggaagaaattttcaacaatttgaaatgctgctgagactttgggaaatgtgaatggtgcccatgtagaagttattgacagtcattgaaacaacactccctttagcattatgtataagaaactagattagaatgaaacaaatggattcttaattccagaattgtggagaaatagaaaatctaaaaacgtattggaaacacaagaaatgcaacatgaactataataaccatccatttcaataaaattagaggatttcaggttcagtccatgataaagtagcacaaactcacaccctgaagttggctagaaaagctgggcaaaatatgttagacaactgttggaagacaccggagaacaatcaatgtatacagagcttgagtgggatcattattaaaaagaaataattatagactataaattacattcactcagatgtttttcctctaataacatttcccaaatactgatgtgaagaaagaaagcatacacggaaagtgaaattttactgtgttgaggtgacagagattagagttcagagtatctagtgtgtatggggctcacgagacaaatttccaagaaggaggtaaccacagagagagagcctgaatatctgcatacaaatgccccttaagtgtggccagtatcaaagatatgtatgcacaaggtgagacgtcaagaagcctagcagaaatcaataaatgggaggttggagtgctgagtttagatttcagctagtggtttagagaagaaagaggctgtggttcaaacactggtaattatagaggatgagatgggagtgagaaactatatggctaaatgtggtcattcttcaggttttagtttttatgcagggtgctatatgctggttgcttctaacactgtaaaagttattatttaattacctacatataaaagatgaccatgaataggcataagatgaaagtatgtcattaatcaaaatgatgattaattcaattctctataattgtgattcaattaaaaagaatattattcatcacattcacagagtaaatgagaaaaatcacataatttcagtagatgcagatacataagatctgtatcctaacagatattgatacaaagaagtatttgataaaatttatcattaatttactgtatatctatatgctcttattaaactaggatttaaaaggcacttcattaagttgataaagtgtatcttttgaaatcctataaacaatatcttatgacataataatgtgggaatgttagaaggcttgcttttaaacctgggaacaagaagagattctctattattttcctatgctgctgtaacaaattgccacaaaatgggtagcttaaagcaacacagactttttctcttatagttctgaaggtcaaaaattcataaacagtatcagtggtctaaaaccaaggtgtgatcagcaccctattttttccagagaactcaggggagagtaattctagaaattattccagaaacgcagcttctagaactacatttcttgtctcaaaggccccttcttctatcttcaaagatagcagcgtataattttcaaatatttctccacttccatgatcacataacctagattctatgtcaaatctccctctccatcactcttataaggacacttaagattgcatttagagcccaccaagataattcatgataatcttccatcacaaaattcttcacttattcacatctgcaagtctctttgccataaaggttacatttacaggtactaaggattaagacctgacatctcttgaggccattattcagcctaacacagatgtcctctcttgctgcttgttttacacattgtacttttcttaatacttttgagaaagtttgctctaaagaagaaaaaaaagtagttctatatttgtgagacgtagactgaggagaatgactatttttctaatgtgatatataaaagcacatttatgtgacaatagcaataatagagaagataaatgaaagttatgcagaagggagaagatttgacaatagcaagcatgaaagtcctgcaggagaaaagtttggatgggatactgaataaaattgtaatattactttttgatgcatacgttcacaccattttttcacaatgcttcctagatttctctgtatttctttcccatctatatatatatatacacatatatgcatatatatatacacacacatatatatacacacatatatacacacatatatatatacacatatatacacatatatacacacatatatatacacacatatatatacacacacacatatatatacacacacatatatacacacatatatatatacacacactatatatatacacacacacacacatatatatatatatatacacacattttgactgaaaatgattgactgggatgaaagaaaatgagaaagaaaaacggaacaaggaattctcaattatataaatagaatattataattagtaaaccatgaataaaagaaggcatatgggctaggcgcggtggctcacgcctctaatcccagcactttgggaggccgaggtgggcggttatgaagtcaggagatcgagaccattctggctaacagggtgaaaccccgtctctactaaaaataggaaaaattagtcaggcgtggtgatgggcacctgtagtgccagctagtctggaggaggctgaggcaggagaatggcgtgaacccaggaggcagagcttgcagtgagccgagatcgcgccactgcactccagcctgggcgacagagtgagattccatctcagaaaaaagaaaaaaaaaaaaggaatacttgataaaaaaggtatccatatatcagatatgaagatgtaaaatttatgtgctatctacttctggaatttccaccataagggaataataatgatgtaggggttcacttgaaggacagaacttgtacttggttacttatgtacacaatctctgccttactcgcttttggtagatcgtattgtgtcatttcaatgtggccattattgtcttttatgaacatatacaacaaagtaatatacctttacataatgtctacatctctactgtaatttaaaatttaatggctcaaaaatgctaaattacaaaatagaggaagatgtgtgttaaatgcagattaatataatttaaataatattatatatgataagggtttgtaaaacttaaccattaagatggatagatgagaaagatagaaacctagaatacaatactagaaaatctagaaacatagtagagatgagttcaataattcgattctatataagaggtcatcaaactacaaagcacagagctaatcaggccactgatacattttggtaaacaaagttttattagaataaagtgacatccttttattttacatattgtttacggctacttatgcactacgatggcaaatattggtactcgtgacagagatcacatggcacgtacattctaaaatacttaatagttggcccttcacgaaaggttttgagagctactgctctaggaaatctcaggttcaatgtcagttatgaatcagcgttgcttagcatagccatgtttgaaatcctttccaatgacaataattgttactgcctctagacagaagagtccaattattttaaggtttcattattaggaatggttcatttaattaagccatagttgttacttcaagtataattaattagtgaagctatattgcttttatgggatataattaataggaaaataggttactgctctgtggcatagttataatttaaatgctgtggctttatagaatttaaaggtagggtctgtttattatgaattatgcctcccatcatctagctcatgtgaggtagttctggaatagcacattatttatgtttgctgataatttattttagatataatggttggttaggaaggagttcatggtgaagaaggtagatgtcacaaaaacatgcctgaaatggtgatggagaagatgaatccgtgtatttattcatttaataaattatgttgtcattcaagcaaatacaaatagtctttactctgaacattcatataaaatatctgttgtataattaatcgtgtgcttctgaataaaatggatgaaagcatagtttgcattataagcattaattcattaaaatttaccctgaacattgttatttggttttattagcaagaaatatagcacttggaatggtttactaaatacatgtgaagaactctagatcataaagaacctaaaatacagaattttcagcattattataatctatttaattacacattcaggtttatttgttactgaaacttagtaacttgattttgggagttttatatcgcttctgtgtcttgtttgtttgcacaagtttgtttatggtgaagtgcaaagtattttagtaaaagggatttgagccacagatgacaaataattacaggaacatataacataaactacacttggactttaaagcaggtttagattatattactttggttattattctttgttttcaaaagggaatgatgggttatagctatatgcctaaatatttaggcaaaacacgacaaaagaagggtgaagagaccttttatctaatggccaaagtagaaggtagcactcataaaatatactgttttgtgtaataagtgaatggaatctttacacaattttttgctagggttgtttaggaaacttttctaattggcaactacttcatagaaaaacttgatccagacctatatgtggaacttccctttatattaacttgctgaaattattaaagttaagagcttgtttttccaggttgatactctcaagacctacaaagaccagcacattgaagcaatcagttgattaccgtcgtgatgcctgcgtatgtttatttcatgtcagacacacctgaggtctgtaattgaatacataaagagtgcaaccatggaagaaacaaggttggcttgtggtgttcctatggcagcatcgacacagcttcaagtgcaccatgagcatgagcactgccaagaaaatatattggctctcaactctcagaatactgccgcgtctagaacttttggccttgccaaccactgggcagtaagagacagtaacaaatcacagcagatactgtttccttagagcaattaaattacatcagaaaaactaagctgagtgataacaaaacaatttctaaatgtcaggagcctgtatcaattcattcataagttgctcatttcacatgtccttggtgttgcttatgattctactcatgggtcattgtcacctttataccaggatctagaggacaaagcagccactccagaacattgaaagttactgtagtcaaggaaaaaaagaatgttgtgaggcacgctctgaatttttgcctctagaaggaaacagacactttagtctactaacatttcaataagcaaaaggaaatcacattccataactgaattaaacagggcagtgagctatatcctaccatgtgtatgaagaagccaaaaaatatgtaagcaatcctaatgtttatcaccttaaatttatccatgcatgccactgtggtcactttcactgtaaaagcagtcattgcagaatcatcactagtatctcagtgtattagtcagggcaattaatattagtttctgaaccaaactgcaaatatctgtgacttaacacaattttttttcttctcattcatataataattcagtagaggattaactttctgaaattccttaaaggttttcactgaatcccctgcatttaatataaagaggagtatgagaagcattgcgtgaggtatcttatagctcagtctaaaagtgggaaatataacttttacctacatttcattcaccagtgaaatggtctcatcctacctgcaattgaggctgaaaaatacagcatttccttgtggtccaaagaaggaaataatgttatctcaccaatctctgtcaaggtcagtccttctgatgccaaaatacctgctttaatcttcctcccattataaaacacactgacttctctcaaaatgaaaaatgcagagttctttcaaggtctggcatccagctcaaaatgtagtatctctggccactcataattctcccagtgaggtccagataaggtcctcatttctcagtaaaatctaaacttaaaagaataaatatgtgtcctgtgtacaaatatgcaacggtgaagtgggaacaaggtggcagcaataaatacatctctatcaccacagtcatttgttcttgactatttgcaaatcatttcaggaagacatggtgaaacatcctacactgtgagtggcagaaccccatgtgcactgcaatctcatttcctaccctccggaggagtatataaacttttcctacgtaaataatggccacatttttgtatcgatacattgtaagttctaagatgtgtgtgtttttttaagaggaattaaaatagaaaagcatatacctgaaagatgttcctcgggatatatctgcatatattctctactcttgtcattttaaataaaaatacagtggtcccttgatatcctcaaaagattgggtccaggaccccagaggataccaaagtcagcacatattcaagtaatcctgtggaaccagagtatacaaaaagtcagtcctccatatctgcgggtttttcatcctgtggctactgtattttgatccacatttcaatgcagatgctgatttttttaattaaaagaatctctatataaggggatgcacacagctcaagctcatgttgttcgtcaaccgtacttttttatttctgtccaatataatttaaataacataattctgtgaactgcatgtcattaattacatatactaagaggtggcataccaatgtgtttaaattccaagaaatggtggctagcaaatttaattctcatctctgctctgccacagacaagttctgaagtcttgagcaaatcatgagtatctgtctctagcttactcaccttaagaaggagccagtaagtagcaattatctttcagtgttcttatgaggagtaaataacctgtacacatcaatgcttagaacagagattgccatgtggtattatgtccagagttggttcctgcaggtgggtttggtgggttcgtggtcttgctgacttcaagaatggagtcacggacctttgccgtgttacagatcttaaagattgcatggacccaacgagtgagcggtagcaaggtttattgtgaagagcaaaaggacaaagcttccacagcatagaaggggacaccagcaggttgctgctgctggctggggtggccagcttttattcacgtattggcccctcccatgttccatttttgtcctaccagagtgccctttttttcaatcctccctgcaattggctacttttaggatcctgctgattggtgctttttacagagcgctgattggtgcattttacagagcgctgattggtgcattttacaaacctcttgctagacaaaaaggttctccaagtctccactccacctaggaagtccagctggcttcacctctcagtatgttctgaataaactgggctattaaatatgtgatataaattaatcaagcagagaaaaagttactagtgacagggaaaaggagaaaatatgtattcaatattattttgtaaacaatttataaatatgcttcacctatgagtttcttctcagtaccttagaaactataacaccatggaaaattttggatagtttagggaagtgcattatttggtaatgtgaaaaataagatggtcgtgataaagcaacttgggaaaaaagaaagggcatgaatcttgagaacacgtactttctgagaattttcatgtttagaaaagagcaagctaaaaatctggaagcgtgttttttcacaggcaattttcaattggcctcatgcatttctgtgcatcttgcaaatagaaaggcactagcttcacatttattacaggttttcctttttaaagatctttatatagtggatagccctggaagatcaagatattgtttatttatggatgagagaacagatttattttcaagtaaaatgaagatagtgtttcctccacagaaaacatcagacaagtgtgcttactgctcatttattaaagatttaagtttcctttacttggagttcttcatctgtgacacaaactgtgtgtagcatcaacttgaactccttgtcatcatctccagtaaacttgagggaaaacaggaaccagagcaaagatgaagctcgtgcaactctgtgctgtgctgcaaataatggaagtctttctgtctctgaccaaagagttatgtgtcttctgccagcatccataaaactgaagcaggctaacttgtaagctcagatccttcacagttcttgacaatagtcccttaaaactgtctgcagatgcacatcccttggaaaaattttgcatccttttaagaataattaatatcctagttaatgacaactatatgacaggatagatcactttaagcttctacccagattactataacttttaggtaaataatgtatatgccactttttctaaggttatctagccattttcgatgtagaaaacaatattgtgtaagataagctgagcgtatttttcacttcgtttttgttttgcaaaacaattttactggttttgttaatgccccaatcatcagtactgcttggtataagagccgagtttgaagaattatcatgttgcaaatgtattttgctcatttatttcaaattagtagacagaattgagaggtggaaaattttagaaaaatcttggttaatcatacttggaatttggttatgtaatatctctttctcttttggggaatacaaaggttcataaactagtgataatcttcactcttggaaccattagatgctatcatgaggttagcacagaagataaatttataatgttgcagtgaggtaaggaaataaaacatgtaagtctttgaaaacaacactatgagagaccttgcaggctaaaaattagacaccaaagcattttttgttacttttggagaataaaagaagtgtgcccctcaatgtcttgtgggagaaaatatatagtttgatacacttgtcaatatctctaactcaaaaatgatgagtataacgagtgacccttattgtagtcttatatttctctccaacaattaagagagttggtggggatgttttttccatgagttcatcctgggccccaggagattttcatcttgtattctctttataatcctatcttagtgtttcatcctcatggctaagttcagcaatacttcacagtaaaatgtgtaagaagagatgtaaaaacaatcggctttgtctttatggagattaacttaaatttatgctcataatataattcatattatacttgatcaaaattaatcactgataagagactatagaaggtaatctcctgcttgtggtcataagtacttaggattctattactaaacaaaatgaaagaatgcattatatggacaattagtggtctctagtacaaagaaattaccaggtcatttccaattctcaatattaaaaaaaagtttatttcttactgcactatcaaattggaaaggtcagtacaggggcattcaataacagtaaaaatatgaataacaatcatatgtataacaacagaatcatttaaaaagatgtatatttaaaatgtgattattgcattttatttcccctggcagaaaataataaactggagaaaaatcacatttgattgatgtctgttacatggatttttaaaatttgtatcaatgaatgctttttaaaggtaaactaattgaggcctaccaaagataaataaatcttaattattttggtaaatatattttacagtttcattctttttcaacttaagttagataatatgtactatattctctcctaatataaatgtttatgagcattgaaactccatctggagaaaatagaaacacttttaatttaaatgacgtttgaagaaggaaatgtataaatgtattcaaaactgtaagtgaaaatgggaaggtcctattaaaaaaaaaagaaaggataaacagtttccaatgacttttctataatattagcaaatttattatgatctgttatgaaagactgttttgccttccttgtttctactgtctcaactccctaagtactaattcaattgaaaagttacttcaggtatgggtccattttaatgtccctctacaagatctgcagtgccattaattataatcatataatcttagagccaaaagggcccttagagattatctaatcctattctattaatgcatgatgaaatgggcttagcaatctgtctaaggttacacaaattcaaaaacacatagaaagttttcataatcaaattaaattaaaagtacaaaacaatgtcactaatttatgtataagaaaatattaaatatcattttatatgaagtgattctgataattttaatgagttcataacaatgcttctaaatatttcaaaattttagtttatcatccaaatataataatatacacttttataagtgagtcttctacagtgaaaattactaattataggaaagagaaaatcatagataaatagggttgtatcaaactcttaaaatgtacatgtggaaatttaaaaatatcctcttgacaaggggatgttgatgtcattccataacaggattgacatgtgtaattaaaacaaacaacaaaaattaagaatatataaataatatttaaatgcttgaatttgttatttataatgaatattgaaatttatttagtgagataaaaggttaacaaattcttgaatataattatactacttttataataaaatgcatccaagctgaaatctcacttctgttgtcaactgctttgatggttctagactcatttccctatttttggtgagtcataagatggatgacacacatgctcaatagcaggttattttcatggctaaggtttatcatagcaaaaactacagagcaaaaccagttctactcatatttttaatgaataataagctaatgatatcttgttattcctatgctttgtctatcatacctacacataaatataagcactggtaagttctggttccaaacatagcttatatatgaatgccataatcattcaacatgcatacattagccttgaattttgaagattaaaaagtgtttgtaaaactacctagaaaaaatttattatgattacagccactattagatttcaaaagggttcatcagaaatctctgaggtatatgatggggaaagaatattttgactaccactttaacaggtctgctatttaataatattagtttctttttaattgatgtttcatggacatccagaatactagctataaaatcatatatgctgcataatgcaagcaaaacaaaagcacctgtaaatattacagaagactatacatgtatgtatatcattgccataaaatacctatatacatatacgtatatacacacataattgttttcacaaccatgatagtattacttacaaaagcatgcaaatttagggagatggctaaataagttatggctttttcataaattgtaagcctattcattataaaatattattgaggatcaactttcatttgttccccaacaaattattgagcatctactatgcatattctaggcccatttgtagggactggggaaaaaatagtgaaaataacattcagaatgtcttggcttcacagagctgttgttccagtgttgggagaaaaacagtaattaataccacaaagtatcatgtgttgtatgccagatggtttaagttctattctaaaaaatgtggcaaagaaggggaatagagagttctgggcacaagaggtgctggatactgaacaagatggttgccgaaagcctcactgggtggtatcatctgaatacaatgagtggttatgagagaatgagccaagagcataattgagagaacatattttcagggagcagaaatagcaaatgaggccttggtgtatgaacgcacccgtgaggttccactaaggatgccaatgtgatacagcagaggagatgagatcacactccatggggagatggtcacataaagcttcttagaaaatggtaagaacttttgtttatttaattggcagccatgaagtattttaaacagaaaagcaatcgcctctttaaagaattagcagtaacagtttgactgatctgtgaaaatagaccatagcatagcaaaagagaaaacagggaaattagtgaggaaactatcgtgtaaactattcctgaagctgttgtaaactataaactatgtaaattataaattgaaattgttctatgcaaacaagatatatttgaaccctgtatattagaggcaaaagtccataatattggcaatgttttggcctgaactatgggaggaacagagttggaattactcacctgggtttaaatttgggaggagcaaatttgggattagaggataggaaagatcaatagttttatttttaacaggcttaattttaaatagacacttaatcatataatatattttaaataaattattaatcataaaataatgtcaggctaattctaatactcacctatcaattataaatatattctgttttttaaataataaatcttattaattttataattatcaaagatgctataaaaagaaatattttttattactatgctactgatgtatttccattgcattgactaacaaaattaatactagaattttcaaaagtatccacagtggttactttatttgcactgttaattcagctctttttaagtataccttctagttccctaattgatataattcagagactacacttggacacaatttaatgaataagcaaattaggtccagttattccaatatgaaattccttttaattatgggctacttttggagatgtagaataatttgaatgtttaatttggtgattcagtatgacctacttcacattgttttatgagtgggtgaaaaatataagtgctaggaaatgtgtaccagaaataatttgtcatctaattacatttcagaacattatacctcctcaaaactttgtttcagcatatatctcattttaaaaatctatgttgtatatatgtttacttctttaaaattttaaaaatgtttgtggcattcacataaaatacagaagagaatagcaataagtgacatacatatacttcaggacctgaacatttatatgactacatttttttctttccttaaaaagaatatattcaaatacatcatgagaaaaatgtatagctttatagttaggataaacctttaattcaagtgctgttacttgaattaaggatgcacaagccccggactctactccacaaaccccacctgctattctcaccacataaatacctagggagagggatctgtctgaaggaacctttcccacaacagcctttattcaaaatgacacacctgccactttcctgatgcctactcttgtactccaactgcagagtgatttattacacacagtttgcttgtatgttatataacagtgattacatcaaggatttgggtactagctaactgaattgatatatttgaaagtactttataaaacagaaagtgctgaacaaccattaagtatacagaatgatttggcaacaatcatatgtagtaccatattttctgaaatatctatttcttaaaaaacaagtttcattaagtgtattatttgctgaataatctctcaaaagtcatgttttcatatagctactattattgcattttgaaatcaaacattattttctttgccatttcagagaagcccttggtaatccagcccgcaaatgcaattcatgcgcatggctctaaagagaaatgggcaaacaaaaagaagtttaactacacattcaataatcatttatttattttcttagagatatctacagtagctctctcttatccttattttaataaatgctgacgtatagaattagtgagatttttggtaataatatttttttttgaggcagagtcttgctctgccaaccaggttgaagtgcagtggtacaatctccactccctgcaacctccacctcctgggtttaagcgattctcctgcttcagcctcctgagtagctgacaggtgcgcaccaccacgacctggctaattttttgcatttttagtagagatggagtttcaccatgttggccaggctggtctcactcctgacctcaagtgatctgcctgcctcggcctcccagagtgctgggattacaggcatgagccaccgcgcccacccgggttataaatttgttattcctcctgtggttgtttggatgtgtatttgtgtgtgtgtgcacatatacatattattgaatttacgacgttactccaaaggcttttctttaactattttgcttgatgtatattcaacaatgatagtctcaaacaaacaaacaaaaaacagaccacacatctgatttttcaccaatactgtttatagaatgaacctgtatagagtctgaggctattctgatgataaattgactataggactagaaaaaactattttgccattttacaaacgctcattatgcaccttatataatagtgccaagttaataaatttgcttctatgtttatagtctgcaacggaaaaaacttacgaggtactattttccagatgaaagtgaaagtgatgacagattttatttcttcacttaaattattaagatatacctttattatgtgagcataatcgattttattgcagggaagtcccttaattcagtaaaaaagacaggattgcttcttgaatattaaaacattttcatcttttcagttttgcttttcttgattatctatttttctttttactgagtagtgtatatcattttttaattaaatataatttaaataatattttacaataatctaaaatgcttctgaatacttcgtcaataacttttggatgttcaataacattaagaacgattacatttttcaaatattatttttgcattatttatatgtttgcatttttacaagtgttctaatcgcatattgcaaggccaaatcagaatttttaaagactttattttattaacatttaattatagcaacaattaagaaataaaacaaaatgacataaaattttaaatcatatgaataaattaaacctatatatttaaattactttacaattttagtatttttcataaatgtacagaaatttcattttgtgtctgttgttattacaatattaaaattatgtaatggaaaaataaattaagcatcaattaagacagcatacatctgttgacaaaagaaagagaaggtatatttgatttccttgattttttcctctcaaaattgagaaatagtttaattttataaatctatatccatttaaattacttaagtcaccattttagcctaattttttcattttctagatagattactcttttttttttttttttaaaggtatcatttattctggttacgggtaaaagacaactttagatgtgcaaatatttagatatataatcacaattagtatttttacttcatgaaatctttaggcgcaaactttgctgttctaaactaaaatttggattccaattcaaaagctaaagactatcatagtgtgattatcccaaatgaactcttttacctaacacttactgaaatttcaagataagtagtattgagattctacaagtcagtaagaggtcttctccctgtgaacttttaggttttaagggcacaaggaatttaatggctactgggctaaagaatgtaataaccactattgtgcatatgattttagtcatataggcaaaaagcctaggagttacattgtttggtcagatggcataagtacaattaattgcaatataaattgtcagattgtttcaaaaagctctacaataaattattcttcaccagaaatatatgagagaacactagaaacaataagtcctatagatatctttaaatgctacctatttgatggtttttctggtgacattcctgtgttattttaatttgtattttctttaccacccatgaatcttaacagatttttctatgaaagttcagcactttgattcattcttctgtggactgactgcctgtgcctatccacttccctggctctcttgcttggtgtgtgcatgtggcttagttttagcaaatagaatatttgctgtccctgagccttagtcttaaatccttatacaagcactttttcttgttatcttacctgtttgtctgacttgggtgatgattcttagagtaattttggttgccaaatgttaaagttagtagaactactataagcctctgagtggctaaatggtagttatttctgtggcctgaatactcttatgagatattcagagagattgagagggaagaattatttttgaagacatggaatttttattttctattccttagaacagtttagtttaccctaaatagtaactacctattattttcctctgctaatttttcttgaggctcctaactttatcaggtgaattttaagacatctgtgaggctgggcacggtggctcacacctgtaatcccagcactttgggaggctgaggcaggcggatcacgaggccaggagttcaagaccagcctggccaacatggtgaaacctcgtctctactaaaaagaaaaaaaaatagctaagtgtggtggcggtcgcctgcagttccaactactcgggaggttgaggcaggagaattgtctgaacccgggaggtggaggttgcagtgagccgagatcgtgccactgcataccagcctgggtgacaggcaagactatatctcaaaataaatacatacatacatacatacatacatacatacaaacacatatatgtaatgtataaatattacctttttgtcatctatttaacaaaatatttgctcaaatatatccttccatctgacaactatttaacattacttttctaatatttttaccttattgctgctgacttgatacatttttattcattccactacatccttgttattttggaagatctatcctttatttctttattaaggggtatcttcaattttttgacctcacaattagatgcataattttcaagtactatttgaaataaagatgccttctattgtcttagcaaattagtcaatttctctacttacccctcctcaataagttgacaaattcaaaaaacataaatttccccatttctttttcaccactcccctccaagaaaccttggaaccagtttgttccaaggtttgttcccaccaaagtctagattatacaaaaatattttagaatgttaacgatatattgttagtaaaattcttctattgaatagtttatgataatttgtcaacatgaaatgttaggcagacattgaataccaactagagctattcatattctcttaacgggatttccattgagttattgatgaaagataaagtgatataaagaaaatgtgtatacaccgagtgcaaaatattttataccctttatgtggccatgaatattaaatcacagttatgggaggaaattgccaaatacatatattaggctgttaaaaactgtttttctgagctctggaaactgatggataggcatagcagaagagagcagaagcaagccaagaaatcaaggaaaggatacagctatataacaagaaataaaataaaagtacgtaatgtaattcccttagaaaatgaagtagggtgactgagaagatgtggagaacctttataccaatttcctttttctaatcagatttgattataaaacatcgacataaaatcaatatatgtgcattatattcatttcaattttaacttcaagacctaattttgctgtcttaaagatcatggataactccatcttaactcagtgttcaatctataattcattaaaacagttttcaaaagaattttcaaaatactttattatgattacaaccatacttaatcttcaattaggacatactatgtgataaatactatggtgaagtacttctcaataatccatattcttaaacacaacaagttctaggatcaaactgcttaaatttatatatttgctcaatcatttgcaacataaatattttacagatgaagaaactaaaacacttttttttttctccgaaactgtttcagggctaactaacttactcatgagcttggtaaaaataaaaattattagataccttgtggatccgttgcatatatttcaaatttaagtttttgaagcactttttgaaaagacttctttatgtgacatttgttcattaaaaacacagtgattcttttttgaaatacgatccaattgtaaaatatcctgtgtctagaaatgaatttattttcctaacaaaaatgaattaaattaattaattaattaaattctcagaaccattatttaaaccaagtgtgttgatcctacaaccagtgaaaataatccctacaatgctaaaaatgtgtgtgctattatccatctatttcctagttcattaaagccaagttatcataatctggactttttaccaaagattttcagggatgtcaaaggtttttactcctaaatttaatatgctgaaatattactttatgttctatttatttttattcatttaaaataacatttttctctatgttgcgattgcaaaaattaacttatttacatatatacatgatgtcatgatatactctaggcacaattttggatatttccttttcccaatctgtttaacttacacaggtaatcaatatatgtaatcaccaagcaaaagaccttccttggtttctattttgttattttttcctctggaaaagagtttaagatagttttaacatgaagaatagcaaccatattttttgcatactgttatttcttcaaagacgcttaatctatataaacaaattttaaaaaccctggtatcagttaggtaaaatctctgagatttaaaatatttactaagctactaaatgttaagcaacacgggattttgagagattggccaatggcaaggattgtaagggaacaaaaacttggaaacaatgctgtttgtcgacatcttgaataatttgctgtgcctctattttatgtcacggtatttccacttccaggcctatacaaataaataaaatcagtgttatacacagaataggtacacacacacacacaagcgttcagatataaagatttcaactgtagcatcatttgtaataaacaatattggaaacaatgttggtatatattgctaagaaaatgtgttgagatcaatttagtataattatataatgagatatatgattatttcatttctttatggaatgagtgtaatgggaaaatccagtggaaagcttacgttaaagctaagaaagttaaatctttaagacctttcatgtgtatgggtctttctcggggtcatatgagttttgcaaaatttgctatgtaagatgcttaattaaaaataagaaaagccacacctgttttgactcccatttgcctttagtcatttatctccctgtcaggtagtgcgggtccagcctacagcacttttagtattcagctaaggggaagttgaagagagacatatttaatttcagttcattgaggttaatgtgcttgatttaaagccacttccatgtaaaatgaatttgtttctggcagttcagagactttctattgctcactccatagattcatccagtgtcgtagcacagaggtgcagaggcaggaatgttgtgagacacatgtcatgcagtacttggtaccagaggctgcagagaaggaaagaaacagctgcccttaacctagctctcctttccactaattcttaccgtggtggtgatgtggtgagaaccagatgtcctacatgtaaggggatctgctgtaggcaaagaactctggaaaaaagaacctgagcatttttgtggaagagtgacccagttgctctgacccccttctgagtgcgtctccatagtcacaaaatggaaaaaaatctgagttcttactctaaccatttggataaaaataaatcactctaggggaaagataacactagagtctccagctttgtaacttctgggatgcatctactgggtctcatcttctcttgaaatgtaaatatatatccctagtgaggtaaatccctcaggatggcccctaaccatgttctttctgtgaattaatttccagagctagttcttagcgtagagcagaagtctgagtaaaatttgttgagaaagttcttactatgcataaataactttatttacagcctaacactatccattaaaatcaataagagaaagacaaactaatccaaaatgaccctgcaatcggggctctaaaacaatgcaggttgactgtaattgttaaaatgaatttggaaagtatttgaccttatctgttaaaattaagtatatgcataccctgtgaccaataattctgctactatcatccaacaggaacacataaacatattcagcaaatgtacaaaattttttattaaagaattattcacaacagcttaaattggaagttttgcagttatccatcaagagtaaaataaacacatcatagcatatatatacatacatggagcattatcaagcaagaaggataaatggtatacccaagagagctttgatgactctcctaaatatatttctgagtaacagaagccatccagaaaagaatatatattgtttaattctattataaaagttcaaaaataggttaaaaaaagtctatgttattagcaatcagaataataattacttgcagatagagcagatggtaatttaagggaattttattgtgaaatatgtacaatcactttgttaaaattaattaactatatactatttgtgtatttcaataaaaatgtttaataaactatctcatcgttgttatttacatttattaaatagcatttaggcatgggtgaaaaggtttaacttgactggcctgaattactcaaatactatacattccaaagaggggtccctctgcaggactagaccttagactaggagttcatctctgagcccttggagtattttgcttgataaaagtgttcttgttttcctaaagtcttgggccatactctcccagttggaccagaaaaggttatgttatcaacgtgacttatgtgaacatctgtttttactctgggtgtaggaagaaagttgtgcttaaatgtcatggagctgaggtcaatcatatgggcattacatgactatgtgactgatcccagtaaacaccttcgacaactagactccagcgagtgttcctggttggcaatgctttgtactttacatattgttgctgggataattaaacatgtccccatgcaactgctctgggaggggacacctgagagcttggacttggtttctcctggagttcacttcatttgtcttttctcttagctgacttctatctgtactgtttttactgtaatatactgtaacaatgagtactacagcttctgattcccttagagacttccaataaattaccaggtctcaagtggtcttgggaacccctggcatattactgaacttaaagttttcagaatatctgtatttggtatattccatggcaagcactatatccatcacactttttcatttattgacataactccaaatatttccacatatctaaaattcaggaaagtaaccctatccttacctctgaggataaagcttgttaagcataggtaaaccatgataatttaaattcacctgtttgtgactgactttttttaatgactgtttttagtcaagaaaatgtgaaggtaggtctgccaagagctactgaaaagagttacattttctaaaaaaaaaaaaaaatcctcatcttttctctttgagaataatttgtggtgtttctgaaatcattgtctgcccataaagagagattacttaaacaaaaagtctgtataaaatatgactacagagaaagatgagaaaaaaatcatattcttgattaatttattgatctattaaattaatagtctaggaagtagatccctctttggacttccagttagagacagggccttactctatggcccaggctggagtgtagtagtgccaccatagctcattgtgtagctcaccgcaacctcaaactcctggactcaagcaaacctcctgcctcagcctcccaagtggctggaatacagacaggtgccaccatgaacacacctggctatttttttttcagttgtagagctgaggtctccctatgttgctcaggctggttttgaactcctggcctccagtgagcctcccacctcagcctcccaaaatgctgggattccaggcataagccaccagacctggcctatttatagtttaaattttctcatcgtctaaataaaagatctaggccgggcgcggtggctcacgcctgtaatcccagcactttgggaggctgaggcgggtggaccatgaggtcaggagatcgagaccatcctggctaacaaggtgaaaccccgtctctactaaagatacaaaaaattagccgggcgcggtggcgggcgcctgtagtcccagctactggggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaaaaaaagatctaaaactaattgtctaagttggtggagcagtcagaacacacacatttattgattaaattcattgtcttatatggatgtggttcatggtgcccaaaacaattacaatagtaacatcaaaggtcactggttacagattatcatatcaaatataattatagttaaaaagtttgaaatattgtgagatttacctagatatggcacagagatacaaatgaacacatgctattacaaagtggtgccaataaagttgcttgatgcagggtggtcataaaccttcaatttgtgtaaaacacattatctgtgaagccaagtgaagcaaagcacaatcaattgaagtatgtctatattccactgcctttttagagtgtatatagttgtattacataacatacataatatatatacaaatatatataatatatatacaaatatatataatatatatacaaatatatatattatatatacaaatatatataatatatatatttgggtatatgtaatatatattatatatatttgtatatatattatacatacatattatatacatatatagtatacatatatattatacatatatattatatatatatatatatatttgatatggactgtgtcttgtttccccaaaattaatatattgaagccttaactctcaatgtgttagcatttggaggtgggacctttggaagtaattaggtttagatgagcccataaggatggggtcttcatgatgggattagtgctcttacaggaagagaccagagagctaacgctttctattcactatgtacgtacataggaaaaaggcagccctttgaaagcccagaagatgaccctcctcagacttgccaggttcaagaactataagaaataaatgtctattgttcagaccagcgcctatcttatttttatatagcagcctgagcttactaaaacaattattaagaaaaaacagcaaagcaaacaaacaaaagcaactatgtttaaaactcctggaaaaataatttatcttctgtgcagctgtttttttaagattttcctttaatgtatttcctctcatttttcttgcgtcttatttggagtctgtagtagcatagttcttaatttgcttatcaagtaatttacatcatattaaacatgaatttcaaccagcaaagaatattattaaaacttctggactaatgttattcacttgtattctttcctactacccggaaatgcttttgctggcaatgatttctcctttgatgttgtgaagtttcgggccattgttagagaaacaggtccacttgctgattagcaggcagtaggctttgtgacctaagttcagtaacagaagatcattactttctctggcaatttgatacaacatgcttcatatattccaaaattcatcaattttctgctccgttgatgtcctcctttattatgttaaagagttgccacagtatagtttattcataatgctattttcagttgaattactagagctccactttagcattttaaaatcatattatcgcatgtttatttccaaattaaaatcctctcttaaaaatcagggatatcagtattcatctctttttatgtaaaaatattaaaaaattagaagtgaaatatcacagaagatattttaaatatgaagacaaataatgaaataaggagaattttaaaagccaaatattttggatcagagtaagaagttagtggtaaaagataaaggttatccaacaaccttttgcaaatgaagccaaaaaagtaggtttgtgcaacagtgaataactaaaattacaactcttttatatttcattaaaaaacatgccctttttcaaaatgtcagatcggtttaatcacaccataaaattatttacccaaagttaaggaaaaatagcatactgtcatataagtagaaaatttaaatacacaattgatatttaacgttctctaagcaatgtaaagatttcttttaagacatctaacagagttgtatttattattagggatcaaaaagtgtgtaaattagcacaatatattttatataaaatgaatctgattgtgttttctcttataagagtatacaattataattctgaattttgaatttattcttaaacaaataaaaacaactgctatatctgaattcttgttttatgtcactcttgtgcatattttttactatctatattttaggcattttctaggtttaagtatgcacagttggagcttactcaatatagcctagcaatgctccctgtttcttttttttaacctttaatttcaggggtacatgtgcaggtttgttatataaatacatttgcatcatgggggtttgttttacagattaattcattacccaggcattaagcctatgactcattagttatttttccagatggtctccctcccccgaccttctgccctcttgcaggccccggtgtctgttgttcccttctttgtgtgcatgtgttctcatcatttagcttgcacttacaagtgagagaatgtggcatttgttttttcgttcctacattcatttgctaaggataatggccttcaattccatccatattccttcagaacacatgatctcattcctttttatggctacatcttattccctggtgtatatgttcaacattttatttatccagtctttactattgatggccatttaggtctattccatgtctttgttaatgtgaatagtgctgcagtgaacatatgtgtgcgtgtgtctttataatagaacaatgtatattcctttggatatatacccagtaatgggattgctgggtctaatggtagttctgtttttaggtctttgaggaatcaccacactgttttccacaatggctgaattaatttacattccctttaacagtgtatagtgttcctttttctctgcaaccttaccagcacctgctattttttgactttttaataatagccgttctgactggtgtgcttactggttcttaatctcacccacatcttagaataatgtggaacatttcaaactacccacacctctttctaaaaactgaagttctgttttaattggactttagtagagccaagaaatgagtattacttaaaatcttgccatgtgattctactaggaagccagggttcagagccatggattacatttttaatataaatacacattattagttgaagcagttttaagttaggatagctgtaacgttgattgaaaggggaatacttaaaacagaaccctgccttaggtcgtcaagacttaaaaaattcttctgtttttattctattaaatataatcatgcattcatttactttagcatttataattctaaaacacattgcaaatttcacaaaactaccattttctaaatgtcaacactctaaatacaccatttatttttcaaagtagtatattcacttcaaattccattgctgtgtcaagagttagttgaacttaaaatataattaatagttactcagcaaaaatagaaagatgttagctgactgtgtcaaaagaaatattttaacactgatttcatttttactaaatgactgaatttttctttatattttatgcttaagcttctctgctttctttctattttttgtggtttaaataaagaaccatgattatctgtataactgattgctcaaagtaattaatcatttttcttatgaaattaccagggtaaattaagaatcataattacagagttttctcttgtctagaggaaacatactgagaaactgtgttaggaaattattatttcaaaacccagtctaagttctcagccactggactttaaaaaatacatattacatatactttttctaacatgattgagaatatagtttgtttcagatttccacatttcttaaatgaaaacaataaagaattcaaaaggcaaaaggtactgtaaaaaaaaaggtattcgatctcatgtaaatgagaatcctacactctcactgaattttactagaggggaacttattgtcacatcagattgtttgttcaagacactatttctgatgtattttattaaagaattcaaaaggcaaaggtattgtaaaaaaagttatttgatcacatgtaaatgaaaattctaccttcttattgaattttactaattagagggataattattctcgcatcaggttatttgccaagatactatttctgatctattttattaaaagtcaccatttatcattggttttcatctcatgttatatatgcaaatgaaactcctttgagtatgcaacggttatttactgcagtgaatatcgtataatcatatttatcaaaatgttcttctttgaaatatttttctagtgcttattagcaaacagtttttatatttgagaaagtgaaacgtggactttagaatcagatttaggccatatggtaagccagttgcctgaaaaatcttcataacaaatgctaatattgatgaattttggagatgtcattatatatgtatacctaaaactacaggaaaacaaagaaacttaccaatgccagaaacacaggcaacacttaaaaccagcaagaccagttgctctgacttttctggatggcaagagagatggacccagcaatttataaatttggatttttttttttttttttttttttttgagacggagtctcgctctgtggcccaggcgggactgcagtggcgcaatctcggctcactgcaagctccgcctcccgggttgacgccattctcctgcctcagcctctcgagtagctgggactacaggcgcccgccatcacgcccggctaatttttttttgtatttttagtagagacggggtttcaccgtgttagccaggatggtctcgatctcctgacctcgtgatccacccgcctcggcctcccaaagtgctgggattacaagcgtgagccaccgcgcccggccaaatttggattttcttaatgctcatcagcgaaggggtgatgcatagctggacctagattgaaagagtaaagaaaaatacttattaaccaacccagtataattaagaagtttgtctgtaaatactagaacaattggtagaaaaaacaaatacatattctcccctgagaatctgtaacatcaggattatccatcatgtgttgtttgacttcaaatttttaaattgtacagccttgaaccatgaaccatcaaattaacaaattaacatatagattattttctggccattgatacactggaagttgggtggaagagatgcaaaatcattccagagcaaaagctgaaaatttttttctgcaaagggcaagataataaacatcttaggcattattgaccattttaaagagcagcttatagtcaccaaaaggaatatcaacaaactagaaagtgaagatgaagaattatccagaatgcagaatatgaaccaaaagatagaacataagataagctgaaagccatggaggattgaataaaactatccaaggaatatctaaaagaaattctgaaaagagaatagtaggaataaaaataatgggattataatagtttgcttctacttctgggatgaatgtagtagttgtataagacacatactcttattaaaatgacaagaaaaagctggataaattataaaagccatatattttttaaagcatgagggaactgtagaaacaatgatgaatagatgaactaagagtacagacatacctgagtgttcgaaatgggccaaagagcatgatgcattcatagcgtctactagtcaattctggcacaaattaggaagtagaaggcatgttcaatggaggcaaaacagtaatatatatataaacatgtgggtaagtctaaagaagcatttgctatattgaatcaaacaaatacaataaagtaaaacaaatactagagaacatcgttaagctgagttaagtttggctcaaagtgcccattgtacttgcctaattaagtttggcccaaagcggcatccatacatagtgactgtactctaacttaatgtgtagataagttgtaagctaatgtagatatatggacttgtaaccaagcaactgagactcaaccaatcataggagccaaacccttagtcaatcctaggctgaatgctgccaaattatgcccaaataaggcaaatattgaactgcaccaatcagggaaactctgaatataattgtatatgttctggttataaatacatctcaccactctggatgtggagtcactctgaacaatctttgttctgggatggtgcctacttctcaaacctttttcttggtcaaataaacttagtgaaatttaacatgtcttagttgcattttttttaaacaacattcaaagacctacaaaataggacagggaacttgtatttagactatactgtctaaatgcaacgtatttatgctagttatttgtgtgttatagagaatatagtgatattgatatactttaagtcatttatgtacatcgggaagaggaaaaaaaagttacccaattcaatggaagtcaaacgaagaagcagaacagagctaccagaaaaacatgataagagttaaagaagatgggagctcaaagaggaaaactgtcactgaatttggggaacttttccttgcaagccaagttaacttttattcagatagaattctcagatgaaaaagaaattatagtctatggctgacaaaatatagagagtctgcccagagacttttgctattctaagctagaatcataaggttaatacactccaatgaaggagaaaacaagaaccagctcttgagcatacttgaagtctgggaccaaatctgagttgttcagatactcatattttcaccctgatttaagatgatctgatatgggtaatgcttgcataagcaaaacttctggaggaacttacctccatagtagacaacaaggtaatcttaaactatcctgacactaattgggtgtataaacttggccaagtaatttttccctttgagtctcagtttcctcaactgtaacgtgaatatgaaagtaactaacttgtaggtctatattaaaaataaagtcaattattttggtaaatcatttgtatgcaatatagcatacatgagagagagagagagagtttgtatgcatgtgtttagagagacatggagagagagacacacatacacagagaagaatcagtatattgttaaggataacaacatccagaaacaaatcgacagacaagaaaaacaatttaaataatagaattatcagacagaagttaaagaacaaaacataggcttaaagatgcacataggaaaatacaaatatgatcatggtagatttagaaaggaaatacctgctagaagtaacagagaactactagaaaattaacgaagtgcagtaggaagaaagaaaataaattattgaagaaaagtttcaagatacaaaggataaagttaaatgttaatatatgtctaaactttaccaggaaaagagagacaaaggcaataactaaggaaataatagagaatgtttttagtactgattgaagacagatataagcagatttaagaaggtcaacaaattctgagtggagtaagaaaagtacaatgaagaaaacaaaagacaaagccaaaattctgtaaagcagcctgaaaataaggcttattaccattaaataacaacatttcagtctatagaaacttacatcctaggagagggaatactttaaataaaaaagtaatggatgaaaagagaaaaattccatcaagtgggataactgttatccataaagaagtagcaggtgagatggggagtaaaaaaacaaacatatataaatcctcttattttatatattatagctcaattttattcccatctttgataatccaaaaattatacactgatcaatatatctgttctaaatgttaagattccaacaggtagatcatgtctctcaaaatgtgttgcacattgcctcaactggaggttcatgatgcatattaaaataagaaaggcttagagaattcttacagcaaggaaaacaatgtaagtttatttaatttagtgttttagctatatatttaataattattttaggtaggcagttgtttaaagacaatagaaattacttggaatttaaagcaagcaaaaatgaatgcgttggaaaagcacaatgcagctcttagaattgaaaaaaaaagtaggtgaaccagcctcaggcaggaatcagagagcaagtcagaaccaatatcagaaaaaggaagttctgcttttcatgtggctattgtcctgtcagtcatgaccgctggccactgccagcaaagcatgcacaggcattttctggaatgctgctgggctctgctttagcttgtcacttcccactttaccattggattcaaaaaatctatccatctgacaggaataatttcagactctctgcctacttcttaccttgcaaggttaaaaatgcaaggaatgagtggctattcttgggtctctggtttacattttagcctccagttggtgggaagagaaaaatctactcacaaacagcttcaaaacggaaaggtcctatattggcattcctacataaaagaaagtactggggggcttgacaaatggacatttgtcttcaaagaacacatattctcctttagacaaagtttgcacttatatagcacaattaacctacttcttatcaatcaataaaacgaagagacaattacagaacaggataaggtgtttgcaaactatgtattcaacaaggtttgatatccagaatatataaggaactcaaaaaactcaatagcaaaagaaaaagttgattaaaaaatggacaaaagaagacatacaaatggccaaaaaatatataaagaaatgctcaacatcattaagcctcagaaaaatgcaaaacaaaaccgcaatgagctattaccttatcccagtttaaatgatggatattatcaagaagacaaaatataacaaatggaaacgataatgtggagaaagaggaatgttacacactgttggtgggaatttaaaatagtatagctgttatgaaaagcagtatggagtttccacaaaaaataaaaaagagaactattatattacccagcaatcccactactgggtacgtaatcaaaaaaaatgaaattagtatgtcaaagagacatctgcacccagggatattgaagcatcattcaaaatagccgtgatatggaatctgcctaaatgctcatctaacaacaaatggataaagaaaatgtggtgtataaatgtatatctatctatctatctatctatctatctatctatctatctatcatctatctatttatcatctatctatccacccctccagaacaatattcagccataaaatgctgttatttttagcaatgtggatgaagttggaggacactttgttaagtgaaataagccaggcacagaaagacaagcactgcatgatcaaattcatatctggagttttaaggatatggagaaagatgttaggttttttccttgtgtgaacaatatttaaaattattatatttggagagataactagaatacttctgccaacttaactatgacccattgaattgctctgaattataaatcagatactctgaattagcacttcactaccatttttaaatctacagcatttatataaattaataactgctgtagagcatactactcatggctgaaaaaagtgacctgatgattcgagctatctaagacccacctgatgtctgacagcactaaggatcaagctatcacctctcccttaacacatctttcacaccagtgtgctagagcagatagctgaaaagttttccctaagccagagatcattctgacaaggcatgtggaacaatggagatgtcagcatgctttcaagacaagtaacagtaatcctggctgttaacttgctttaataataatgaattcttttatcaagtcctgaggaatgagggcttccaggtgccgtatttccaggtgcttatcagaatttttctttgctgataagaacaattgttgcagcatgctttgctaatcatatacagaaagacaagaaatttatattctaataatagaacacaagtccatctcttgcatctgatttagccagattaagtcacctttccaccaatatcaatctggaagtgatatcatgaactaaatggtgtcaacctggggtttgtattatatctcgacaaaggaaaagaagttgccatcattggcaaggtacatacaggatacatctctgtttcggcagatgggatgagatttccctgattctcctacactgcagagggtagagggaggtatttatataatacacagaattttaattgaagaagcaaagaggaatggattaatgggattaatagtgtttatccaatacaagataaaaaacaacatattattgtttgtatcatgatggttctagaataaaacacatcatttctctaattttagttagatctttgctgaaagaaaaagataaataaaataccctacagtttatccatatccatgttcctctacactaaatattcatctttgattagttatttttaactatatttgatttctttataaattaccttttgaaactttaaacacataaagacattgtttccccttaaaagatttttcttttcctttctttttttttaatctaaaacttactttcaaaaacaatgactttcataaacttgcaacttgttaaatatagtatttttattaacattctagtttgtaacacaaggcaaaacctaaacacttaccatttataaataatgggtaatactgtttcaacttaaccttgagaatgtagaaaaaaaattgagtccagtctgatagcaaccaaaagatctcagaaacagtaatcttagtgctcgcctggcagacacaatctgcacagaacttaatcaaaataagattaaaagtccatagcaatttccttgagtggccagtcagatatcccccattacagtcaccaaccagcctgcccctggggcctatttcagaaataaattggtttgcagatgagctgatgcagaagaaggaaaaaaaaatgttttcttgagactgtacctaaatcttatcaagtaatacagggaagcttcaaagtctttttattctgaaatgttattttattctgctttatatcatcttaaatttattagtattatattaaatattagtttatgtaagcttattatttgactctgtataggatataatagatggcattgaatatttaataagatagcaacagcaataacacctgggaaattgttcagggaaggattctattcagttattaaaagatttgcatacttatttcactaatattactagcaatcacaagcattgggtaatgctagacaaatctgcaagaggtaccgttattccagcaccttaaaaacatttttcaatctgaaagatacttctagatgtttttttccataacagagcagatgatttctaagtgtttatatcactgaaacttcacagtattagtggaatatgttatcctttataccaaaagtaatcagattattttataaagcaattatcaattaaaagtagattactaagaacatactgtataaaatgccttatgggctattaattctgcatgcattgccacatttgattgtctcaaaaaacctcctgaaatatgtattcttaacacacttttactgagaacattatgagtaataaaagttgaaagattttcccaaagatgtacaagtaaaacaggtcctcaaataaagttgttttattcaatgttgttttgctataatgtagatgagaataaatattgattcctggacagggctaccatctgtgtagggtctgcatgttctccccatgcctgcatgggttttctccaggaagtcctgcttcctctcacatccccaagatgtgcatgtctggttaattggcatttccccactgtgtgtcccaatgtgagtgaatgtggttgtgccctgccatggaatagcatcctgtgcagggtttattcctgcattgcatgctgagtaagaataggttcttgccacccgagactctgaactggaataattgggtaaataatcatcttacttgtttttattaatctttttaaaaatgtatgtatacctcacacttatttcagtgttgaatgttataagtgttttagtctccatttagaagtacagtgataatattgtgaccagaaatatgcagtaggaacttatatcttgttgtatcaattggcctatggtaaaatttgtttcattgttcaccattttgctgatagttgcagtttccaataatctactgatattaaatgtggacttactatgtaaacaatagcaaggatcctaaatcctaggtcatatctaagtttaaatggcttgacaccaagtcagaattgccttatgaccatgctcttataagtgtttcattttttaaaacagtgcaaactgaattttgcatgagaattatcattaaaaaaatttttgttacagataggatcttgctatgttgcccaggttgaccttcaagttctgggttcaaatgatcctcttgcctcagcatccagtgtacctgggactacaactgtgtgccaccatacccagggctgcaggaaaagttgtgatttcataaagcagtgatttatgaaaataagactttatttgggcaacatagaaaacgtaaacaaaaagagttgctcaacataaaacttactcaagtcacaatttacctctgacatgacatatttccatccacttcagaaaaaaaagtgtatacctttttatttcttttttttttcctttttttttttttagacgggctggagtgcagtcacagttcactgcacctttgagctcctgggctaaagtaatcttcctttctcagcctcctgagtagttagaactaagacatgcaccaccatgtctggctaatttttaacacttttttgtggagatggagtctcgctatgttgcccaggctggtcttgaacttctggccacatgctatcctctcacctcgaccccccaaagtacttggattatcggctcaagtacttagatgtattaaccaggatcacagagagcttgattttgtaagtttgagtcagcatgtaataactgcagttgattttgatgcatgtatttaatgagaatcattgctttagactatatgatatttaaaacaaaagagcaataggactgcatggcacaatataaagtctgttatgacatagtgactttaatatattttaattaaaattataatagtaaaagctaaaaatgacaagacaattgttagaaatcatatcacgacagcataatcatgtatccacaagtgattgatacaataacatgaactgactttttgctgcaatattaatcagttaatacaggtttttaggtttcagttaactggttaatcataaaatattatataaaatattatcaaattgtgtaagtcatctcactgtattctaaaatttatgttattttatatttctaatctatgttttgcagagatcatgaaaattttactgggtaactgaagaagaattgtcccaaggacttgaataaatgttaatgttcataacagtatgttctaaaaagaaatttaagtaaaaaaggaaaaaacatatttcattttaaaaatatctacccatgcacatcattcatctaaaaaacccatttaatataatcatctagttatgtaaagatatacccaatagctacttaaaatagaaatattctatttcattattagaaattattattttaaaaggttgttaaaacatcaaaaatatgcttatttctagtaaccagagaacacagcagggttatgaaactttggattcctgtttgatttggcaggtaactagattaacaaaaatacaaggttttgagtttcaaaacagaatagcatatttaaaaaatacttggtgggtgtctggcaattgagagaccttagtagcacaatcattggtcttcacaatcactgccaggtactctttcaaactagcttgaataactgcaaaacacattatcaacccagcttctttttgctggacctgggcatatataaactgattagatttaaaaataaaaaagagttttttcagttgtgtttgaagaggtgaatccttggactcaaaatctctcaaaagtcctgtctttcacttcagaatctgcattaatttgcacaggaatatacttctgtgttttaataaacacatgcaatttttctgttttcatcttgcaagtaatgacagctttgttctcaaaccaattttgttttttgtagattttaccctgatatataatgaagagacagttgcatgatctgtgtagaaattcttcctctaaactaaattatactaccttagaaatctgacatgaaagtaccaaaactatgtaaattgacctcaccaagaaaattattacataaaacagtgattcatggaaataagacttgatttgggcaacatagaaagtattaaaactaaaaaggagttgcttgagataaaatttacccaagtgacaattttacctgtgacaaacatatttccatccactgcagaaacaaatgtgtttagtttattaaagtatatgtttaacagcaaaaaataaatagaataaatttattatccctatccagtgataaacacaattttaaaataaaaatgaaaacatcctgcttatatttgctatactatttcatgcattaggctaagatatatggttatttccatgctttcaggatgtgtttaacaaatctcttatacattttcctattgttgtcattttaatatcttgaatataatattaaataaacatttctacaaataatttgaacctcaaagtttcataaacatctatccttcaatatttaggcctaaaaagtaatctccattatctatcaaattctaaatttgaacttactatggtttactcctactttttaattattactttggttaaagatacttcatgatattattaagttccttactaataatgtatatggttgtattacattcatttatccatcaagactaactttgagctactatgaaatataattcaaatcattcacataatatctaatgaatgattactataatacaaagcactatactaggtttcataagtgatacaaaaacaagtgcaaccgcctcagtaaccaacacatttgcagtctaatagaggaaaacaagccctgttataagaataattatagtaaaaggctatataaaatacaatccattttgagacacaccttcaactctatttgctaattctcattttcactctttagtttatttttagattaaatagttattttcacaaatcagtctgaggacagagttttttgttttgttttgttttgttttgttttgttttgttttgtttttgtgagtcatcagcactatgcaattgcatatacctgttgtgtttagtctacaaaggctgaacatcatgtaatagtttttatgcattttgttcataggttactgggtgctttaaggcaaaactgaatgagtttccaatagtcagtacaaaactacaagaaatacaggcacaaagtgcctggggttatcctcagatgaagttagatttgaattgcattcaataaccttttttacaatgtgtagatgctcaaagcaaatacaatagtttctctttgcctctgtgacttgagttcatagtgttgtgtttaaatataacttttgtaatgtctacttcactgaagaaacttttaaaaaatttgacttataatggttttctgtaataacctatggtgcttggtttgtaaagtaaaacaggaactcaatttagtacctactgaataataacattttttaactgagattccactcataaggcacctaaatttttaaagttaaaacatattatattgacattaaatttaaaaagaataaacaagttagagaagaaataaaaaaaaatcttcagagaataaactgcttccaagtacacaagtactaaagaggctacacactggtatgctcattataaataaaaacattcattcatgtaattttatctcattactacatatttaaaataatctcttatcattatagtaggccatcattttccaaatagcatcaagaatccttattttgaaatagtaatcagatcatgtagttctcctgatcagatctcttcacactctagaataagatgcataccttcattttagcttttagactttttttctgatctagctctagattattgtttgatctcatttttactattcttctcattgctcattcaattcaatttcaagcataatgattttttgctctttttggaatacactagctttttgatttcattagagcctgtacacttccctcttcctgaaatgttcttccccaaatttatgtatagcttattttctctctttgttcagggctcagtgtaattgtagattgttctctaccttgaatatgtcttacccctcatttgactggttttccttcataccaattatttgtattctaaaatattttatatttttctgttgacttgttcactgagttccttcctctaaaatgtagcttcatgaggtcaatattttgttaaaattgtatgctactgtatcactagaactgagaacaatgcctgaacagagtagctactcatgactcattggctaaaacaagttaatgaatgagaacaggcaggtagaaagccaggaaggaaaagaggatattatattaagttgaatgagggattaaatgaatataaataagctgaaagtagcataggttatgcaatatgcttaacaaagtatgtttgtctattttcgttatgtaatccaaaacctggccgaccacaaaacttgctttttattcactttctctttcttccctgtttagtgcagcataaaattagttatcgattttatctcttaatgctccacctctattagtgaaaggatcttctcttatcatatttccagtccaaagttcagtggaaactttttacactcttacagtctatttgaaatccttatatcataaacataccagcacttatcccagcactattcacagtagcaaagatactgaatcaacctaagtgtccaccaatagatgatttgataaagaaaatgtgagatggtaccatctcactccagttagaatggagatcactaaaaagtcagaaaacaacagatactggagagaatgtggagcaataggaatgcttttacactgttggtgggagtgtaaattagtttaaccattgtggaagacagtgtggaaatttttcagggatctagaactagaaagaccttttgacccagcaatcccattactgggtatatacccaaaggattataaatcatcctactctgaagacacatgcacacatatgtttattgcagcactgttcacaatagcaaagacttggaaccaacccaaatgcccaccaacgatagactggataaagaaaatgtggcacatatgcatcatggaatactatgcagccataaaaaatgatgagttcatgtcctttgcagggacatgaatgaaactggcaaacatcattctcagcaagctaacacaagaacagaaaaccaaacactgcatgctctcactcataagtgggagctgaacaatgagaatacatggacacaaggaggggaacatcacactccacagcctgtcagagggtgaggggctaggggagggatagcatttagagaaagacctaatgtagatgacaggttgatgagtgcagcaaaccactatggcacgtgtatacctacataacaaacctgcaagttctgcacatgtaccccagaacttaaagtataataaaaaagatttccacctaaagataagaagatatgatgatatacacagtggaatacaattcagcctttaaaaataatatactcatgaaacatgtattttggagcagtttggatggaactggaggacattatcttagatgaaagtcagacacagaaagacagatactgcatgttctcatttatcaatgggaggtaattaatgcattcacatggacatagagtgtgcaatgatagagacttggacatgaagacttggaagagttgggggagagtgagaggggagtaaatgataagaaattacttaataagtacaaggtatgctttttaggtgatgaatatgctgaacatcctgacttcactatgcaacctatggatgtaacaaaattacagttgcactccataaatttatagaaataaaataaaataaattacattttaatagagacactatcagagaaatacaccgaaatgactggactgaattggaaatggaaaatgtagaaatctcattttctcttcagagactattgcaaatttgtatgtatgtaatacactaatcacatcagatgccagttttaagaacatattttcctccactgtgtagatttgtttcaatacggaaaaatttcagaacatacgtaatcaatacaaagccattctcagtaatttattttcattccatgccatgttacttaggtttacatttactaccttagaaaacattatgtacaaaagcttttctttcttatagtgaattaaatctccaactgcttttgtttctattttaagaaagtaaatattatgacataaatgtttgcaatgtttttgtttaaataaagtatttctagatttctcttaattcatagttacgtttgtttctttattgatgttcaaacacagacttttaaaaattcatatttttttcaaaatgtgtaactatttactttctagttcaatttaaaaagcatttaccataaaaatggcagtatctttttgtacagatgctacctctgaatcaaagcctctcagcaactggcaaacaggaagctctaatgcactttaaccctaatagttataaaatatgcaatcatctgaaatcacatactgatttccacttcttttctaactacggttatatgtaaatatttcactttcaataatagatctttgcctgtttatttagtttttttttttccttggcttagaaatagtttttatgaaatattcaaatacaaacatagtctctaaaagcaaagtatggttctttgacagccaaaacactttcccctaagcatttcattagttatataagtgataaatgtttttctgaatgggaatttacctaaagtgtttcaaaattaggtgaccatttgtgctttccaaaccatacagaactttatatttattcctgggtaaatcacccatttccttgttcatcaagatcaggtgaaatgatatccatgtgagataattaattcctctgctatctattttattatacttagttattcatctaaaataaatatctactataacaagtaaaatatataatagtgtagaagacaacaagagtatgtgtttgcagtatgtgtaatagagttaaatatatctaaatatagtatatctgtactaaggcaatgaacatcaattgtagctaatcaccctcattaaagcaaagggcactaccatatgtgacatagttgtcattgacagcctgttaaatcttgtagctgaggtaacggacagggaagagtttgtgatagtgaaatttgtagaactaagatcaaattaccaaacacgtaggcattattaaacaaattctcaccaattacttcaaaaatattgtaacttctatttaatatttcttgtttttaatcttaaaaactctaaattgagtagaatttgaaatagcagtaaatttcaggttaatggaaatacaatcacacttgttattattgttcaattttttttattaagtctgaagaaatatttacttgaatatgacatctaagaatgatggacaaaagctttttaaattttctttccactcctttttctgaaagctttgatacaaaaatcatttgacacaaatggttttttttttgtgtgacaggatcttactatgttgcccaggctgaagtgcagtgtgctcatgcaatcctcccatctcagcctcctgagtaactgggactacaggcacatgccgccatgcccagctaatttttgtatctttagtagaaacaaggttttgccacattgcccaggctggtctccaactcgtgggctgaagtgatctgcccaccttggcctcccagtgttctgggattacaggagtgagccactgtacccggctgatgcaaatgatttctattattaatatcttgcagttattcttccattggataaccatcaatgtcaaaataaagattattagttactgaaggactgaaaaatcaaaaatcaacttcatgagatgctttacaaacaagtgttctcttttaatatttgactcagtaaaagtttttaagaaaagttaagtttgtgtttttatttgtgtatactctctagtgcttaaatgtatcaggatagaacttttctaaactaggtcagtcttttttccatatctatggttgaatacttcagttaaataaagcaatggtagatagcaaactatgttataattggcattttgggcacttgttgcaattaattgccaaaaaaagcatatctcaccacaattgatctctcgtttttccactctcatttatttcccttcactttcttcttggcttctgcaaaagcatttgtttttcctttttctttcttctttaaaaaaatatatttgaagagatttattctaagccaaatatgagtaaccatggccagtgacacagcactcaggaggtcctgagaacatgtgcccaaggtggttgggatgcagcttgcttttatacattttagagaggcatgagacatcaattaactacacttaagaaatacatcagtttgatccagaaaggtgggacaactcaaagcagagggagtgggggtgggaggggttggggctggcaggggggttgggggatgggagggtattggggtttgggggttggttccaggctataggtgaatttaaacattttctggttgataattggttgagtttgattcaagacctgggaatgatagaaagggaatgttcaggttaagataaaagactgtggagaccaaggttcttttgaagtcttacagtggctgcccttagagacaataaatgacaagtgtttcctattcagatctttaaaaggtactagacttttagttaatctctttagaactgcgagggccattttttcatattataatttatctccttcatgtctgtaacaaagataggaatcgctataaagtgtcttcccagtttctgcctaaccacatccctggatttcctggctcctggcttggcatatgtttggggttagccttctcccactgctaatttgtatgccataagatggttgttttgttcctcagtacatttatgtcagatataattgttactgtagtaaacaactattgtgtaaaaaaatgataagtgagtgtgaaagtaaaaaaaacaaatcagaaaatgaagcagaatgtaaataattgataaagacaagttctgaaaaaatatcaaattggattgaggagtcagacacctgtaagaggtttatttgaggggctaagcgtgctggtatttacacacatattacttcttgtgtctcttcaatttattggttcatttcaaaaaaccaaagctaaaaatcataaaatattcattaggtaaaaagaaacaaagttcaatgaatccatacatacataccaaagacctttgtcggatagttgacaagtatatttgcatatatgttttccaaggtaaaagaaaatttgtggctgggcacggcaactcatgcctgcaatcccagcatttcgggaggccaaggccggtggatcagctgaagtcaggcatccaagaccagcctggccaacacggtgaaaccccatctctgctaaaaatacaaaaaaatagctgggcatggtggctggcacctgtaatcccagctacttgggaggccgaggcaggagaattgcttgaacccgggaggcagagtttgcagtaagctgagatcaagccactgcactacagcctgggcaacaagagtgaaactctgtctcaaaaaaaaaaaaaaaaaaaaaaaaaaaagaaagaaaaagaaaaaagaaaatttgtaggatatggataagtaatttattttagaagaattttttttttgtagaatgatttgtgctaaagcaatacatctctttctatcatatactgatatcttgaaaacttttataacgtttcttgtcacattcagtattttaaaaataggattgattctaagttttgagtttatggtgtatttgaatattagagatattatctcttatacatttcaaagctttgctgcattctaaactcagtcctgccttagccttagtaatggcaatgaagtgcggggatagaatgttcactatttttttatgtgctgttaaaatttcatacctcctgttctatcttgaagtcttacagttttggaatggtgagtgggggaaacaagcataaaactattacataattcatgcagttttcactgggcaacagtatcctctgaatggtgaaatggctacttttcatttatttatttttttctctcctggggtaaaacgcttgaaaactgcaccactgggaaattgcagctatagtccatgtttcaacatagtccatgcttctttgagttggccacttactgtttactctcatctccttaggtttagcagtaaagacctgtaagatttcttctgttaggatcatctagccattccaaacatttctcttagatttgattctttcaagacaaatcaacccaataaaaatctcataaataaaggtgagctagctaccacatttggtgtactcatctgaccaaaccaaattttatgtatacattcaattctcaatccaacccagtctgtttgcctaagccattccagacaaacttccactttgaaggttttaaatgcataagtcagatagcaatccttcagttgccccagaggcacatcacgttctttgaatgcttcagtatagtcctcttcatttagcaatcagtgaggcaatacactggcatcatgatccctttttttaggaactctgtacaaaattccctttgaaaatataaattttggaaatgagtgatgagcaaaggggtttcattaacattatcacaatctcttgatatatctgcttgataatgtagcacctattatttggggccattaggaccttggcagaaattctggtaaatgtaaagaaaccacatttaacatccagttaatttagtttgtttgtttgttttgtttttgtttttgtttttgagacgttgtcttactctgtcacccaggctagagtgcggtggtgtgatctcgactcactgcaacctccacctccaccttctgggttcaagcaattatcttcctcagcctgggattacaggaacccaccaccatgcccacctaattttgtatttttagtaaagacggggtttcactgtcttggtcaggctagtcttgaatgcctgacctcgtgatccacctgcctcgacctcccaaagtgctggaactacaggcatgagccaccttgcctggcctcaatattgtttttaataatttctgctttacttgcagttaatcatatcaggccgtctaccatacccagttgtgtcagcaagaagatctgtacaatgataagtaacacatggctcccagggctaacatattcctaacacttatataaacactttttcagaaatttgacaatattttataattaaacaatatcttattttacaagaaaagatatggtatcacaatactctgagcaaagagttaatttgcttctcaaatttcctagataatgaagtagtcctaaaatatttaactcagtattggtaatagtttcaatttgaggaagtgttctgaatagcctttttaatgctgatgtcataagattgtgttacaaacacagactttcatttaaagacactttatgtttaattttgttctaaaaaataaaattatatataaatacacatgtatcctaaactatatatgtataatatacatatatgtatatatatacacagagagagagagagagagagagagagagaaggagagagaaacagagacaaagaaagccataaatcctgaatttgttgttgtcaatggtgtttgatagcatcactttgtaactcaataggatgtatctgcacaaagctaaaattaatttatttttgccatacaaggcaagtgtatcttgttgacatctatagagaaaataaatcaccctctaaagaactgtttataaataaataattgatatctgaaaattcagaaaaagtaccactatcattttacttaccatattgcattgaaattatatgtttatgcttctcttgcttctacctctctgtgaattcaaggttagaaaaggagaaatttttatcttagcattcccaggaccaatcacaatatctaatacttagagcgtgcaatgttggttgaactgaaataaatctgatataaaaacaaataatgctttagggaagtgatttttcatttgagattattttctcagaaaaattaatatgaccaggttttcatcctatgcaaacattagtatgccttattgatttttcactaagttatatagcttatattataagacttttttatgggtgtctctacctacagattccaggcactaacaaacctgtagaaattcataaatttaatgcattttatcaagttgattaatatagcatgaacatttttgaactggcttcacaaatcatttattgttaaatgttattcttatacctgtattagagagaaaaaagccagaggtggcaaggtgatatacagatcaactggaaatccacaagttttggtttggaactctttggaaaattgaataaagagtcacaccttgctcaaaactgaattagtaaaagcgatgcacatatcaataaacaaacttctctaataaaaaaaagcattaaaaatatagtcagcatatatttttctggaatataaaattgaggaactagaataattcaacttgaataagtgtaactaattcattttctgcaaaatattacccacagtttgagtatttttctatttattctatcggaaaaaaatgatataccactgtactggaaatattcagaaaagtttgtctattttttaaaattgtacttattatacctttataaccgtgagataatatatttattatttgaatgagaattaaatgtttatgatttatacaaaaatgcctgacacagactactatgcccacaaaagttgaatggttgtttttagcttatatatacctatacaggttaatagatatatctttacttcttttttctttttttttgagacggagtctcactctgcagcccaggttggagtgcagtgacatgatctcggctcactgcaagctctgcctcccaagttcacgctgtcctcctacctcagcctcctgaatagctgggacaacaggtgcccgccaccacgcccgtcttattttttgtatttttagtagcgatagggtttcaccgtgttagccaggatggtctcaatctcttgacattgtgatccgcctgccgcagcctcccaaagtgctgggattataggcgcgagccaccgcacccggccaatatatctttacttcttataagaaatgagtaactttattaattctaccaacagataacattcttcctctcagagattaatatgcaatcatttcctaaccttattttattgcgctatattttaaatataataaacgtgtcaaaaatgtggtttcatactttttataaattgatatatttagctaattacactaaatctagaaaatactattgtgcttattcaaacttctcttctcttcttcagaggcaaacctgtataatttctttggtttgtttgtttgttttaagacgtagtcttactctgttacccaggctagagtgcagtggtacaatgtgaggtcactgcaacctccgcctcccgggttcaagcgattctccggcttcagcatcccaaataactcagattaaacccttataatttctatcatgattgattaattttgttcatcttcaaattccaataattagaattcctacaggatgtgtgtgtgagtgtgtatctggtttattttctttagcataaataaatatttgagatttagccaaatatttgtgtgtatcatttttttatttttcctcatatttctgagttgcctacgtatttgtcagagtttgcttattcattagtctgttagtgaatattcagattgctttcagaattagcttttacaaataaaggacttaggtgcattctcaaacaggtttttgtgtaaatatatgcttttatttttgttggataaatttctagaattgaaattgctgtgctatagggtagatgtatgttggccttattgagaagcgaattatttttcaaagcggttgttccactttttttttttttgagacacagtcttgcgctgccgtctgggctggagtgcactggcgtgatctgggctcaccgcaagctccacttctcaggttcacgccattctcctgcctcagcttcctgattagttgggactacaggcgcccgccaccatacccggctaattttttttttttttttttgtatttttagtagagacggggtttcaccatgttagccaggatagtctcgatctcatgaccccgtgatccgcccgcctcggccccccaaagtgctgggattacaggcatgagccaccgcgcccagccagttgttctattttacactctcacaagaaatagacacgacttctagtttccccacatatttgccaatattagtattatcattttaaatggtagtctttccagtttcgatgcattttggttgcatttccccttatctaataacactgagcatcttttcacattcttataagccacttgtatctcttgttttgtgaaatacctgttcaagattcttataactatttagtggatctcaggagtactctgtgcgttttgaacacgcaatttttttctcatacatttatcacagtctatggcttaaaattatattttcttacattttgcagttttattaggatacatttttaattaatatctacaatttatcaatttttactcttatgatagtgctttctctgttcagaaatatttttcctattataatagctcgcagatattgtttaatttttttcttttaaaagctttctgaattttgctttttcatttttatgcctacattaaaaatattggactagttttgtgtatacaaaggactgatgcatgtatttttttaatatgagaatgcatttatttcaaaagcctttgttaaagacttactttccccactgaattatctacatgcccttataaacatttaatttactgcataggtggaggtctaattttgaacccttctttatccttattatttttgtgttatgatgctttgatactgcagctttcttagatgtctgaaaattggctctatttttttctcaaaattctaggtcctgtgaattttccaaacaaattttggaaacagcttgtgaatttctctcaaaatgtttgccacaatttactacagagttgtagtaaatagatatagaattcattgtagtcaataaactacaaactatagattgcattgatgcttttttttttttttttttttgagacagaatctcaccttgtcacccaggttggagtgcagtggcacaatcttggctcactgcaacctcagcctcccagattcaagcaattatcctgcctcagcctcctgagtagctgggactacaggcccgtgccaccatgcctggctaatttttttgtattttttttttttagtagagacagggttttatcgtgttagccagtatagtcttgatctcctgaccttgtgatccgcccaccttggcctcccaaagtgctgggattacaggcatgagcaaccgcgcccagccgctactgcattgattctaaagattaacttccagagaattcacatcaatgttgcatcttcaaatctatgaacatggtagatctttacatttatttaagtcttctgtaatgtttctctacaagaaattttaaaaagttttagtgtgaaagatttttaaaggtttcacttaaattattcttaactatttttataccattaaaattttacttttaaatgtattctcaattgtttatttctagtatttagaaattccattaattttccatattatattttgtgtattgaccttgcattctacacattctgcaccattattgaatttgattcttattattcacagctttttaaataaatatattaggattttcttcatatacaatatacatatatatgttctgtgaataaaaatattttttcttttcacttttcaatttttatgcttttcatttcttaaccccatgcaagtccgaaatccagaggggcagccaaatcttaaagctccaaaatgatctcctttgactccatgtctcacatcctgatcatgcagatgcaagaggtgggttcccatggtattgggcagctctgcccctgtggctttgcgggatatagcctgccttctggctgcttttgtgggctggtgttgagtgtctgtggctttcccaggcacatggtgttgttggtggatctaacattctgaggtctggaggatggtggccctcttcccacaggtccaccaggcggtgccccagtagggactctgtgtgggggctcccacccaacatttcccttcctcactgccctagcagaggttatcaatgagggccccatctctgcagcaaacttttgcatgggcatccaggtgtttccatatatcttctgaaatctaagcagatgttcccaaacctcaattcttgatttctgtgcatccacaggctcaacaccacgtggaagctgccaaggcttggggcttccaccctatgaagcaacagctcaagctatactttggtcccttttagtcacagctggagtggctgggatgcagggcaccaacaccctacactgcacacagcatggggaccctgggcccagcaaaaccattttattctaggcctctgagactgtgatgggaagggctgctgtgaagacttctgacatgcccaggagacattttcaccattgtcttggggattgacattcagttcctcgttacttatgcaaatttctgcagccagcttaaatttctcctcagaaaacgggtttttctcttctatcacattgtcaggctgcaaattttctgaacttttatgctctgcttgccttataaaatgaatgcctttaaaagcacccaagtcacttcttcaacgctttgctgtttagaaatttcttctgtcagataccctaattcttctgtcaagttctaagtttcactaatctttagggcacgggcaaaatgctgccagtctctttgctaaaacataacaagagtcaactttgctctagtttctaacaagttcctcaactccatctgagaccacatcagcctggatctcattgttcacatcattatcagcgttttggtcaaagccattcaaaacgtctctaggaagttccaaactttcctgcattttcctgtcttctgctgagcccttcaaactgttccaacccctgcctgttacgcagttccaaaattgcttctgcattttcaggtatcttttcagcagcatcccactctactgataccagtttactgtattagtctgttttaatgctgctgataaagacatacccaagactgggcaattgacaaaagaaaaaaggtttaattggacttacagtttcatgtagctggggaagcctcacaatcatggtggaaggcaaagaggagcaagtcgtatcttacatggatggcagcaggcaaagagagcttgtgcaggaaaactcccccttataataaccatcagacctcatgagacttactcactatcaggaaaacagcacaggaaaagcctacctccatgattcaattacctcccaccaggttcctcccacaacgtatgggaattcaagatgagatttgggtggggacacagccaaaccacatcaatgaagctctctgttgtatatgttaatgctgataatgtttttttgttttgtttttgagatagagaaggagatcttagagacaaaaaaggggaagctccattaaaattggtaaaggaagaaacataatatgaaaggagggaaataatgaggtaaaagatgcagagactgctttccagacaaagtaagaatgaacttcactttggaataacaaagcagtgcttgcttggcaaggtgagtcttagaatctgactaacatcaacagggcagagtctcaggtaattaacaaaaccaggaaggaacagggagcagcaatgctaaaacacaagaaaccaggttactttgtcctacttcatagttgttattttcctaatcattggagataagctatgattaacagaaaaactacccatgtaaaatattgtcacccaacttttaagaaaaacaagaaagaagatacaaaacttagcaaacagaataagtaatttcagagaatcagaattaagaaaagaaacaaatgtaattacagtaagtgtaattcatatcttcagagacatgcaagaagaggttacattttagaaaatactgataatagctcttggattaaaaactcaacagatgttctgaagagaacaatagacatagttaaatatagatctagcaagtttgaagtttaaaagttgaataattttctctgaatccaatggctaggaaaaaatgaagaaaggtaaagggaggtaaagtgaagataaagaattgttgacgtaaagttgtttaaaatgctagaaaaaaaggaaagtaaacataaagatggaaataattaaagaactaatttaaatattttttagaactagaaatactgtagatttgagatttaaagttttcatagaagtatgaacttatattaatggagaaattctactgacagacatctcttgaagaagcaatgggatactaatgattaggacagaatcataaagacttccagagtaggaggatagaaaggtaattttcaatggaataagaagtagatagaaaatttattcttaaacatgtagatgttgttaataactgggacaagaccatcaatgtctgaagaaataaatgtttttacaaatagtgtcctataagtacccaaatacgcatttaattttgtggacaaagcaaagacaattgtgcatatctcccaattcccaagcatttaaaaatccaaaaataaaataataaaattaacaaacagatttttagaattatatctggcaggagtttggatcagtcatagagcgcaatagcatacttgaaaataaggacaatatagccattttaatgatattgattcttcctatccatgagcatagaatgttttttcatttgtttcatcctctctgatatctttggtgtttttagttcttacagagatctttcacctcactagttagttgtattcctaggtatttgattctttttgcagcaattgtgaatcagattgcattcctgatttggctctccgcttgactcttgttggtgtatgggaatgcgagtaatttttgtatgttctttttgtatcctgagactctgccaaaggtgtttttcatcttaaggagctttcgggccttaagcttttgggcctataaagttttctacatataggatcatgtaatccacagacagggatagtttgacgtcctttcttcctatttgggtaccctttatttctttctcttgcctaactgttttggcaaggacttccaatactatgttgaacaggagtggtgagagagggcatccttgtcttgtgcacaaaatacactaaaataaaattgcttaaaactagtgataaagaaaaattctcaaagcggccaatgacaaaaacacagtttgcacagaggaacaaaaaatgccagcaaacattttattggaaacaaagaaaattagaagataatgaagcaacatctttaaagtactggaagataaacattgtcagctgggaattgtagactcagagaaactatctttcaagatgtaggtgaaataaagattttgttcaggcacttagaacctgaaagaaatcatcaccagtaaaacaacactataaaaaatgttaaagaaaatgtttcaggcagaagtaaaataatatcaaaaggaaatttggatctacatagaagaatgaaaagcactggaaatggtatcaacatggttaaatatataagatccttttatttctgtttgaattcaattgattgtttaaacaaggggtcagcaagctatagcttcatgggtggactgcctgtttatgtgaacaaatttttactgagacacattcatgctcatttgtttatgtattatcaatgggtgctatagaattacaaaagcagaattaagtagttgtaacagagcctaatggcacacaagcctaaaatatttagcttttaaggaaagcatgtccggttctggtggctcatgcctgtaatcccagcattttgggaggccgagatgggcggatcacgaggtcaggaaattaagaccatcctgggcaacatgatgaaaccccgtatctactaaaaatacaaacattagctgggtgtggtggcatgtggctgtaatcccagctactcgggaggctgaggcaggacaatcgcttgaacccgggaggcagaggttgcagtgagctgagatggcactactgcactgcagcctggtacaaagctagactctgtctcaaaaaaaaaaaaaaaaaagagagagaagaaaacaacattattaacctctaatttaaacaagaataataacaatttataatgagcttacaacatatataaaaataaattaatgacaataacagaacaacagttaggataaaataatgaaaatgttgttacttcatgatactgtatgtaaagtagtatattataatttgaaggtagaatgtgatgagttaaacatgtatactacaaactcaaaagcaaccattaaaattaacaatatagagagttttaattctcaagtaaaaaaggagataagatgaaaccataaaatatatttaattcatagaaaagaaggcaaacaagagggaaaataagcaaaaaacagatgggatggtaggggaagcaaaattttattaccatcttcttagttttttttttttcctctgctaagcctgagaattaaattgacataagacagatcaacaggaaaatgcatacaaatttattttaatgcatgtattatgtggcatgcgagattctttaaggaaggaagactccatgacataatcacttatgttctgaagtagacacagagtagtaaattgtgaaatatgacaagacaaaggagctggaactagtgtagttaattgggtgaagaggtgattaacaggataagggttggtttaacaaggtctgtttgtacaggtttcccttgcctcaacttctcatcctgggtgatgagactgttactttccttcttgtataaagagggcaactttcatgtagaaattttacctcctacttttaagaaaaaggaaaatcagagtgctttaaaggaaaatcagagtgcttttcttgcatctgctatttttcaagtgtctttaactcaaaaaaatcaatatgccaaagtggcatgtttgggggtatctggttctgaattccttcaggaaagatagaaagcaaaagcaaaataataggtttaaaactaaaaatatccaggtgcggtggctcacgcctataatcccagcactttgggagactgaggtgggcagatcatgaggtcaggagttcgagaccagcctggccaacatagtgaaaccctgtctctactaaaaatacaaaaaattagccaggcatggtggtgggcacctgtaatgccagctactcagaaggctgaggcaggagaatggcttgaacccaggaggcagaggttgcagtgagccaagatcatcgcattgcactccagcctgggcaacagagccagactctgtctcaaaaaaaaaagaaaaaaaaaagaaaaaaaaatatatatatatgcacacataaccacattacatataaatggtctaaatataccaatttaaaagcagattggatcaataaaacaagatctaagttattactgtctagaagaaattcaagaatatcctaataaaagatatctatgtaaaaacaatagctggcatcatacttaatgaagaaaaatcagtttatttcccccgatttcaggaacaagatgagtccattaactcttagcactttgttttaacatttcactagacgttctaccaagtaaaatagacaaaaaacataaacaaaagaattacagacgggaaaggaaaatgtagattgggtttatttatagacggcatgtctatgtagaaagtccactgaaatctacaaaaacactgctggctataataagtgagttagcaacataaaaaagaaaaaaagcaacatattaaactaatatttccatataccggcaatgaacaataaaaaattaaaataaaagtactattaataatatcatgaaaaatgtagaagaattaggaattaatctatcaaatgatgtgagagtctggtacactaaaactcaaaacactgcagaaagttaaagaagacttaaataaatggaaagatgtaatatgaatatgggttagaaaattcacatggtaaaatgtgattatccctaaatatagattcaatacaatcccaattaaaatattattaggcattgttttataggaatttacacactaattttaaaacttcagtagaaatgcaaagagtctaaaatagccaaaataatccttaaaaataagaatatttttgaaggattagcacaatctaataccaaagcttataaggctacagtaatgaaaatagtgtgatattggcataaagatagacagaaatgtcattggaagataatagaaaattcagaaatatatgtacagaattttggtaaattggtgttctccaaagatacaaaggtaattcagtaaataaaagatagcccttcaacaaattctgctggaacaattagatactcatatgcaaaaagtagaactttaacatgtaactcatgatacaaaaattaatttagtacagatcatatgcctaaatgtaaaatgtaaaaacaaagtgaaaaaaaaggaagaaaaattatgtataggagaaaatatagaaaagtatttgacctcaggctagtaaatactacttagacatgacacaaacaccatttcatcaaagtagaaattgacaacttgagttcatcaaaatgtaaaacatatgttcctcaggaaacactgtaaaacaaatagaaatataagacactactgagaacaatatttgcaaaatatatgtctggcaaaaaagttgtgtccagaaaacataagaactctcaaaacttgatgataaatctaacaactctaataaaagtaggcaaatgacttaaatgaatacttcttctctaaagaacatatgtagatagaaagtaaacacatggaaagatcctcaatatcattagtcattagggaattaatctgtgtctgtcaaaaatgagttgggtacagttgctcaagcctgtaatcccagcactttggaaggtcaaggcagcagggtttcttgaccccaggagttagagagcagcctgggcaacatagtgagatcctgtctctacaaaaaagaaagagacatggcatggtgtctctatttagctaggcatggtggcacatgcttgtagtaccagctactcggaagctgaggtgggagaatcacttgagcccaggaggtggagcctgcagtgaactatggttgtgccaatgcactccagcctgcgtgacagagcaagaacccatctcaaaaaagaaaaaaagaggccaggcgcagtggctcacacctgtaatcgcagcactctgggaggtcaaggtgggtggatcacctgaggtcaagagatcgagaccagcctgaccaacatggtgaaaccccatctctactaaaaatacaaaaattagctgggcatggtgatgcgcgcctatatcccagctacttgggaggctgaggcaggagaactgtttgaactcgggaggtgtagattgcagtgagccgagatcgcgccattgaactccagcctgggcaacaagagtgaaacttcgtctcaaaaaaaaaaaaaaaaaaagaaagaaaaaagaatggctaaagttaaaaaggctggtcatgccaagtgttggcaatactatagaggacaaccaacatacatgcactgctaatggtaatggaaattagtacaatgactctggaaaaaggcttgacagtttttaaaatattttgacgtatgcacctatcatatgactgccaatcaatttgtagggaaatgaaagtatatgtacataaaaaacttgtaccaaaacattcacagcacttttttataggagagaggggctaatagtgaagagcatgtaacaatcaaatattcattaacagataaatgaataagcaagctttgatatatccatattttgaaatactacaagcaataaaagaaatgaaactttcatccatactataaaatagattaatctcaataaatatgctaattaatagaagctagatcaaaagagaacaaacagtatgatatcatttatataaaaagaggcattagagcctagtagttaagagtgcagcttctggaagcaaaatccttagtatgatgttttggctcattgactgcagcatttattttatgtgcgctcttgaggtttttatagaaacaatatgcctcagtttactcatctatataatgactatatcgatagtcatctactttataaaatatatattttataatgtaatactttataatatatatttgatatatattttaaaatgtctttattatattttataaagtataaataatataaaataatatctatagttgttgacttataaaaataaagattaaatgaacaaaaatatgtgaagcactagtttactacctagaaaatggtacattctaaatatcttcatgattgtaataaataaatgtatccttatatgttattttattaataataaacaaaaatttatttttagaataatgaatataattatttttatttttagaataaataataatgaataataatattattattcattcttatacacctttgaaaaatcatagggtaaaatgattgaaattctgtgtatagcatctcagcagatgagatctataagaaagaaccattgcacccccatttacttaaatcagttatagtttaagttgtttgaaaaaagtcatttattggaatcaccacatgacatcaatcaagagcaaagtgtgtagaatactgtcaagtttttctccaagaatttatttctgttttcaatttgcaactcactgaagcattgaacattttatgagctctacagctaacaatgcctgggaatttaaatattttccatggaatatgattacttcaaatgaaaaaaaagaagcagaaatgataatgaataatttaccatttatatatggtacaaagtagaatctttaaaaataaagacacaaacagcaacaaccacaaaaacctcaattgtttctgcttttgttctatttttagtgaacttaaaattttaagagaaagtctttctccttgtttttaacacgtgtagagagaggtgtggaatattgtaaagctttttatctgactcggcctgagtctcactagatgaagactcatcgagtttagtaggccgaatagttttttctaaaagatatgtgacacgttaatccttggaatctttgaatataatgacacgttaaacagtgaatattaccttatatggcaatgcttgtgattaagttaaggactttaagggaaggggcttattctgaaatatactcacgggtctttaattcaatgacaaatgtttttttttttttttttttttgagatggagtcttgttctttcgcccaggctggaggagtgcagtggtgcaatctctgctcactgcaacctctgcctcccaggttcaagcaactctcctgcctcagcctcctgaggagtgggattacaagcgcctgccatcatgcccagataatttttatacttttattagaggaagggtttcaccatgttagccaggctggtctcaaactcctgacctcaagttattcgccctcctcggcctcccaaattgctgggattacaggcatgagccactgtgcctggcctgacaaatgttcttttaagagtgagtcagagggagacttgacacacagaagaggaggcaatgtgaccagggagcagagattggagtggtgcagcccccagaagctggggtaaaggaatgctcgcatgagtaaaggaatgctggcagcccccagaagctggaagatccacagaatggattctctctagggacctcagagcgagtgtggccccactgtatttaggacttctagcctctagaactgttttagaatacattgctgttgctgaagtcatttagtttgtgtcaatttgttgtgatagcctagggaactaatataatgaagcatggagagagagagagagagaggataaaaggtgaaaaccatgtgccaaaactaaagaaaagagatgctgacatttgtgattaaatagaataattgcactatttaagattaatcacttgagcctcggaggtggaggctgtagtgagtcatcatggtgccacggcattccagcctgcatgacagagagagactctgtcttagggaagaaaaaaaaagattaaggtggtccagaatgcacccaagcataaaatgcaaagatgatcttgccccatgtatattttagcatactacttaggtactgtttattttttaattatctcctttttacattttgacaattttaccccagtggtcaagccttgtattagaaaagacagaaagaaggaaaagaaagaaggcaggaaggaaggcaaggggaaagaaggggaaggaaaggaagtggaagggaaggggaagagaaggggaagagaaggggaagggaaggggaagggaaggggaggggaaggggaggggaaggggaggggaaggggaggggaggggaaacatgttgctttggacagaataaatgggtaagggtttctattttaattagattaagattaattagattaaacctctgaggaagtcttacttgagctgagaaactaaatatgagagggaggagtaccactgcattggttatagatggggtagaagtctacaaaagagttcattgaggaatagaatagtaaataagtgacttaataatgagtttgttgccgggcgcagtggctcaagcgtgtaatcccagcactttgggaggccgaggcgggcggatcacgaggtcaggggatcaagaccatcctggctaacacggtgaaaccccgtctctactaaacaaaatacaaaaatttagccgggcatggtggcgggagcctgcagtcccagctagtcgggaggctgaggcaggagaacggcgtgaacccgggaggcggaggttgagtgagccaagatcgcgccactacactccagcctgggcaatagagcgagactctgtctccaaaaaaaaaaaaaaaaataataataataataatgagtttgtattgttcttattttgcaaaagaatgcaagatctgggtagagaaaaggcaagagggaggacttcccagattgaatcaataatattaacagtatcaatctgccactaataattatttaagaaaagtatttttctttcagttttatttattaaatagtttctactagcctaatgttaaagtctgccaactagtaccttcaagttaatcacattcacttttgattccctcttaacacattaagatattttataactctgtgagtttaaaatctgatgcaaattcattgtggtcaggcaagatgcaagaccagtcaggcaaatacacttcccttattttttatgggtctgaaatatcttttgtcttgggagatgtattattatacaaaagatctatttggcaatttatagtttgctttttatctattcaattgttccctggtattcttagaacagaaaagcgaaccttttaagaataataacatgccaattacctttaattactctccagctctttcagttaaacaaaaaaaccctctcattttaggtttagtttgtaactgaatagaacattttatatctaaacccttaatggaaaggctttcctatttcccacaattttcttttctatttaatgtattctctaaatttaatacattatttaaaatgccatccatatacctgatcaacttgaaaagatggagaaacacacaagtaaagtttgttatctgttcacattttattctgtttccattttcataatcaaataaatgtagactgtaaaatacttatttacaaatctgtctgatttatataataaactctgaggaaactggaatgaagcagtgctacaagcaagggacagaataaagttttgtgtattaattacctgatttatactttagtccctttaagtaaaagaacgtaacaaatagaaggatagttattaatatatttggaggagaaagaaagataaaatgaaagatacaatgttcttaaaaactgagagttttatcttttttcagaagtctaaaaaatatttaaacatcttcctttatgttagcgcatatttatgttatacatttcatttacaagtaattgtatggtaaatagttacaaaaacaacaaggaaaagctttgagttaaggagctcatgattttcagtgtaaaatacatgttatttgagtaatttgggaaactgacagaagctttcttgcagtcaagaatgctgctcaaaaattaattttaaaataaaaataaaagaaaaaaaatcctgaaagcttatgtagcaaaacaagtattgtagtccattacaaaaattagccttttctgaaatcatgttaaaaagcaaaaagatcttagagcagaatttcatgtacagttcattttgggactgatcttacttccttggtaggtggtcttacttcatcctgttggagcccatcatggagagctgttttacaaatattcttagctctactacccacataaaaattcaacctatgactcctgtttctgataaagtagctatttaaattcattaagaatgtttcatcattttagtatgcaaaatgcattgttagattatgtaagtgacacatgctatcttaaaagttaataaatctcccagaagaaattagactcagatgctatatttattatggagaattaagaaatacctaaggttactgtgatcatcacttaggagttttgaatcaattatatgagaaactaaagaagaaactttgaccggaaaaaaaatgaaccaacaagaaaaaaattatataaagtcattttattggacacaaatgctaaaaattagaaaaaccatacattttactctatcaatctgttaggaaaaactatagaatatgatagtgattgcattgattctgcttagcaaattaaatgcaaaactaagatattcaccaaatataaaatatagttattttctaagaaataaaactcacacaactgccatttttagcagaatggtggcaactgccatttttagcagaaaccaaaactatttcctgttaacaagaaggaaaaaccatcagtgaacactcaagtaataatcaggggactaggatggactctcagtaagaaaccactggaatatacctggactaaatctattctaacaaaattaagtataccaaccgaatagttttgtgtgtgcatttgtttttactatatacttttataatctcaaaagtacctaaaaggaggcaaaacaagaaaggatttgtctacagaaagtaaaaataagaatgattataaaatattgttaaagaaaagacactgcacagaatagtcatggagatttctgtactaatcaccttgatcataatgaataatcactgaatttcactggcctattttcctccacaagattctatgttaggtaagcaactttgggtaattcaataataggaaagatgtttcttttataacatatctgatttgtacaactaattgaaatacattttatgctataaaataaaaatggtaactcttatttacacagctatttattgtgaatttgtataaagacagctcatccttagaacataatagactaggattcttggtaaagtatatattgtatatctgaaaaatgtaatagtgacaatattaaagtgttgccacttagtgctgtgttacctaaagtgtgtgacgctttctgtcagtcttatcactgacatttaaatttcagatataggtgaattcaatattgaagtgaatagagctaccgacatttgctttcctaatattcatggaagttgttgttgacctctcatagataaataagcaaataatatcttcaaaaatatatctaacttgactcaaatacttctaagtattttgtcatttgaagggatatgagcaagttgagaagaagaaatgtggagagagaaatattcatgaaaactaaatttataacattcaactattgctcaattcttagaaatttaatcactacttatattttaaagcaaaatatttttgaacttatttagaaaaatatgacttcatctctcatatgtccattcaaagttttaaacaaagtataaaaggaaattaaacagtggaggaaatgagaaaggtcacaggcattcaagaggtttcaacaaatttctggaggaatgaaaggtaattgaaggatgtgttaaaataatttctattattatctttatagatttagtgtccagtaaaccttttataaacaatccaacttgctgttttgtgttcttgaactttatttaaactgaattatattgtacatatccttttgtgacttaatcataccactgcatattaagtttgtgagagtaagccacattaacatatctaaataaagttatctattttttttctaaagtgtagtattccactgtatgaatctaccacattctactgttgtttaacttttgcattgcttatagtacttaactgagcctgtaaatattttggattacatttcttaatggccaaccatgtacatacaaaataaggagtgaaagccaattgctgattagaatatatggtcatcttcaatattactgggtaatacaagactctttttaaaacggatataatttccatttccaggaaagcatatgaaattattattgctctatatgtttgccagaagtctgtcttgtcagaccgtttttggtcaatctcttgtataagtaataatgtacatataaaacattttcatttgcatttttgtgttaaaaataagttaaagtgattctaaataggtatggtggacacttacattgtacattttataaagcacatgtgcaagccattttctttgttttactgtcgggttttctgtaatttttgcctggctttacatttaaatattgattgccaaggaattgattgttaaatattatataaggtaaagaatcactttaattattttccatatgtatagccagctttctcactctcatttattggcaaatttatttttcaccactgatctataatactagctttcttacatatcatgggttcttatattttccttactgtagtctacctattccatttcattgattatttattactttgttaataccacattgcattaattcttatatttcctgtaatatatttttccttcctcaataaattattaactgaattttaatatttttagagtttacataaattctagaattagcttgtcaatatctaaatcaaaccttactgggttttactttggatgcactagttacaaagattaattttggggagaagtgatttcattaaagtctttcaattcaagaatatatttatgtcaatgttatgtctatgtttatttgaactttatttaaactgagttatactgtacgtattcttttgtgacttaatcatgccactaaatactatgtttgtgagagtaagccacattgacacatctaaataaagttctctacttatttgaaatgcatttcaatattgcataatacgtttgtgtcaaagcatcttgctaaaagctcatattcattagtataatgtatcttagaatcattttgaattttctgtgtacttagtgtcatcggtaacatagtaatctgttttctctttcataattcttatttttttaatatttacaatcctatcccagtgtctaagacctgcaaaaggataaataaaattgcttgtaccatctatgtttattttgttcccaatcacaaaggaaatatttgaacattccattgttaagtgttataatttcaatagaacttttgaaaacaaatgttatcagttaaactagattctcttttaatttcgggttgttaaaatgtatgactttttaagaaaataaaattaaatatgcttataatattgttaagttatttgttgtggtgtatcatattaattgatacctttacatgaggccattattgcttcccagggtttcttagaataaacattggctgtgatgtcttacattttaatgcattgcttatttctgcatggaacttttttaagttttccttcaatattttcataaattacattggtgtttaatttactttccctttactatccttgtcaggttataatatcagagtcataatagcataataaaataaaatagagtatgttctttcctgtttcatgctcagaaagaattgtatgtaagattggaattattgttttgtttcatgtttgaaacaacttgccagtaaagtcatcatggcttgaaattatctttatgatatgatttctgactactgattacatgcatttgttgtagcacaattcagatttttcttttcactttaggttacttttggaaaaatgcatgtttcaagtaattgtacacattttacatatatttccaaatttattgaattaaacgttttcatactatactaatttaacttcttgatatttgtattatttataacaaaactcaataaactgtggcaaataagccagacagtatttataaataaagtattactggaacactgtcatgctcattcattgacatactgtcaatttatgccacaacaatagaattgattagttgcaacaaaccatatagcccaaaaacctaaaataattaccaacagatcctttccaaaaaacaaaaaaaattcttgacacctgatgtataattatttcctattttgattcctgagatggcatacttgtttcttctcttaattttatcaagccatttctccagagttttgttattgtatggctcctacaacaactaacaaacttttggccatatttcttgacttttctttccctgtattcttaatcactatgcatgtatttattatttccttttatttctgttgatatttctaacttctaccaataaattcaaaacattttaaaaattaatttgttgtcctcataaaataagaatttaaggttctacattttcctctaaaatgacacattttataatgtagtatacattttttaattaaaaatattttataatttccattatgatttgctcttgggtgttgagttactaagaagtatatttctgaggtttttcttcaatatgactgactatagatatttgactctagttattctcagaaagagaaagcaaagttatggataaataatcgttaattccaatatctatatagacggaagtgtgctagagcaccacaagaagaaatttgaacacagaaaaataaggaagcaagaacccagcagacattatactctgagggacttgatgttccatggaaaagcataggtgggggtgtcttttgctcttctcacctctgcggcagactgcttgtttctgaactgttggagagccctccattctcacaagcccaagcactggtgtgggccgcaatcttggaacaaattgaggacagagaacaaggctactatttcctgcagtgccacttgcccttcacccagccccaagatgaggtggtgggcaccatactggatatgcctctgtggtggacttctatactgcctttgagtgagagagaggcttgccccatccccttgccggcttccttctccgtccctgcgtcgagctgtggctagatttctccatgagggcagagggcagggcaagaggcgtgagaagcatcttctggaaggtctgcgggcaccctcctgcgggtggacaatgagcgcctgggaggccgttgtccttggttggggagcggtcgtctggatctagcctagcaaagaggctgctccggatggggaggaaatgaaaacccctgcagctccgacgcagatgcccacgttgcccaggccttcacagacccccaagccggaaccgccgggaaaacgattgccaaccggccacaacacccaggcagagacgcggggagaggctgaccagaagaaaggccgacgtgcaagaaacccagcctccggcgcacagggaacatgtgtcccaaggcgcacgcacacacagacggacagagacagaaagagagggcgacggaaagagcgagaagggagagagggagagagagagagagagacttaagagagagacggtagtgggcacacagacacgcacgcgcgcgcgcgcgcgcacacacacgcagacacacacacacacacacacacccataacggacacagacatacagcaggtaacacccacccccaggcagcccctgaagctgccgggttctggtctccgcgactacgagccaccggtgagacagcagcccacgcgcacacagggagacctgtcctcgacatcacaagggcgccacttttggggagactcacccgcacaccgtccgcgcacgcctgaggctgggatcccgcgctgcctccccggcgatctgtctgagttttcttcctcctggggtttcttcctgctggtggaccctccgcgaatcccggcctccggagaccgtcctggtaactgccctggccagggctggtctcagccccgactctgacgcacgatcacacagggctcctacttcgccaagtctcaaggacccatccccgggcaatggtggcggtcactgtgaccaaagcggcggctcgggcctcgcgcatgcgcactggcgaggccgactcacccgccccacccccccttactcggcagagtcaggctgcggaccttttaaaaaatggcggcgacgcggcggctgcggggactggggcggcggtgctggaggttgcggcggcggctgcggcgcagcccggggcggcgggtgggaagaggactaccagaggggcctgcgggagacccagggtcggacccataggagtcctgtcgtcaggacctccttgatcggtcttctgcttgggttctcggtgaaggaggagcttcggggtgtcggctgggctgcgcggactcctcttgggatccgatgatggatcccacccggtgatcgggaatggggttacaatgcagtgaggcggaaaggctctcgccggggcacagaaagatccccagggccacaaggcgtgctgtcgcctgcaaaggcactgacccacgagcccactgcctccctccttcctgggtggagcaggggcctgccttcatctccaaggcccgggggctccggcatctcgacgcggcttccggcgacacgggcaaagagagacagaggctagtccgagccggagccagtgtgaccacacgtggcactgacgtcccccaagagcacatgcagtgagcctgtgtctctgaggccgtagtgggcgacgatgagacggacagtgatgtccaggcctgcgcccgggggccactggagacctgcccctcaaagcggaggaaacgccaagcgcacctgaaaacctgcgagacagggcctgtacacgagtccaatactcctacttcgccaagtctcagggacccatcccccagcaacggtggcggcgcagagaagagcacggcgccggcgcaggtgcagagagacaggaggctgatggggggaagttgaggcacctggggcagagaaaaaaatgcatcgccaagcggtttctgggtcatctactgacgaaaatgtcttcccatcagcccttgcgctggtccccagggaccctggcatccgtcgttggcgcccagggtgcgcgtcgggccactaggggtaccccaactcggacagaaggcccatgagttgaatttgaagtttgtgggaatagaggtgaggcaccaggggcagaaaaaaaacaggagacctcgcctcagacaagcggggcctgggtcccccatggatgaaagtgccttcccattatgctgtaccctgggcagagtggacagtgacgaccctggttcgagcccagggtgcgcttcgggaccgcttgcggtaccagaaagcgaacaaatggtccatgagcggaaggtgaggcacctgaagcagagaaagtaaagaaacgcgccgccgagaagcagtgcctgggtccctcacggaggaaattgtcttctccttagcccgttcgcttggcactgaggtccctggcgtccctggtttgatcccagggtacgcctcgggccactagtgttagcccaaggtgggcagaaagcccataaggggaaggcgaggcacctggggcagagaaaaaaaaaaacttcgctgcagagaagagcggcctgattccccacggacgaaagtgtcttcccatcagtccctgcactgggacccggggaccctggtgtccctggttcgagctcagggtgtgcctcagccgctacgtgcaccccaaggggagctttgggagcacaaagcccatgagggaaggtgagttttgagggaggagtggtgaggcacctgtcacagaaaaagaaaaaaaaacaacccgcgccacggagaagcagggcctgggtcccccacgatgaaaatgccttcccatcagctcctgctctgggccctgtggaccctggagaccctggttcaagccacgggtgggcctcgagcccgctaggggtacccccgtgcgcctctctgcgcctgcgccggcgccctgtgcctttgcgagggcggagctgccttctcctcagcacagacccggagagcattgccagggcggagctgagttctcctctgcacagacttcggagatacagcgaagcggagcatgttctcctcagcacagacccgggcgggcgggccaggggcaccgcgagggcggagctgcgttctgctcagcacacacccgggagacaccgcgaaggcagagcagcgttctcagcacagaccttgtgggcactgcctcgctttgggactactcggagccgcatcaatggtgaataaaatccttcctgtttgcagcccttaataatcagggtcagagaccagttagaagggttcagtgtggaaaacgggaaaccaaaagcccctctgaatcctacccaccgaggttctccccagccaaggcgaggcggccgcagtgcgagatccacaccgcagcctcggaagacaagcgggcagaaatcccatgaggggcagttgaggtttgaggaaggcgaggtgaggcacctgtggcagaaaaaaaaaaaaaaccgcaccacggagaagcagagcctgggtccccaacggacaaaagtgtcttcccatcagcccttgcgctgggcccaggtgaccctggcattcctggttcgagaccagggtgcgcttcaggccgctaggggtgcccaaaagcgggcagaaggcccatgaggggaaggtgatgcacctggggcagagaaaaaaaaaaaaaaaaaaaccgcgccgcctataagcggggcctggctcccccacagaagaaactgtcctcacatcagcgcttgcgctgcgccccagggaccctggtatccctggctcgagcccagcgtgcgcctcggcctgctaggggtaccccaaggcagacagaaggcccatgagggaaaggtgagacacctggggcagagaaaaaaataaaaaaactgcgccgcccagaagtggggcctgggtcccccacagacgaacgtccctacccatcagccctgaactgggccccggagaccctagcgtccctggctcgaaaccagggtgagcttcgggcccgctagtggtacctcaaggcgggcagaaagcccatgaggggaaggtgaggcacctggggaaaagcgaaaaaaacaaaaacaaaaacgtcgcagagaagcagagcctgggtccccgaggaagaaagtgtcttcgcatcagcccttgcgctgggcctcggggaccctggtgtcccagtttcgaacccagggtgtgcgtctggccactaggggtaccccaagtcggacagacggcccatgaggggaaggtgaggtttgagggaggagacgtgaggcaactgtggcaggaaaaaaaaaaaaaaaaaaaacacgccgcggagaagcggggcctgggtccccaacggacgaaagtgacttcccatcagcccctgcgctgggccccatggacactggcgaccctggttagagcccagggtgcgcctcgtgcccaataggggtatcccaaagcgggcagaatgctcattaggggaaggtgagacacctggggcagagaaaaaaaaaaaccgcgccgcaaagaagcgggacctgggtcccccacggatgaaagtgtcttcccatcagcccctgccctgggccccatggaccctggcaaccctggttcgagccccaggtgtgcttcgcgcccgctagggttacccagaagccggcagaaggcccatgagaggaaggtaagacacctggggcaaaggaaaaaaaaaaccgcgcttgcagaaaagcggggcctggctcctccacggacgaaggtgccttcccatcagcccctgcgctgggccctggggaacctggtgtccctggctggaaaccagggtgcaccttggacccgctaggggtaccccaaggagagcagaaagcccatgaggggaaggtgaggcacctgcggcagagaaagaagaaaaaccgcgcagcggagaagcggggcctgggtcccccactgacgaaagtgtctttccgtcagcccttgagctgggtcccgaggacgctgacatccctggttcgagcccacgctgcgcctcaggctgctacgagtaccccaaggaggaaagaaggcccaaaagtttcagctgaggtttgaggcaggagagatgaggcacctgtggcagaaaaaaaaaaaaaaaaaaaaaaaaacgcgcagcggagaactggtgcctgggtctcccagggacgaaagtgccttcccatcagccactgcgcttggccccatggaacctggcctccatggttcgagcccagggtgcgcctcgggccgctaggggtaccccaaagtgtgcagaaggcccatgaggggaaggtgaggcacctggggcagagaaaaaaaacaacaaaaaacctcgccgcggagaagcggggactgggtccccccaacggacgaaagtgtcttcccatcagcccttgcgctgggccacagggaccctggcttccctggttcgagcccacagtgcacctcgggccgctaggtgtaccccaaggcagacagaaggcccatgaggggaaggtgaggtttgagggaggagcggtgaggcacctgtggcagaaaaaaaaaacgccccacggagaagcagggcatgggtcccccacggacgaaggtgccttcccatcaggccctgcgctgagccccgtggaccctggcgaccttggctcaaacccagggtgcgcctcgggccgttaggggtaccccgaggcgggcagaaagcccatgaggggaagttgaggtttgagggaggagaggtgaggcacctgtggcagacaaaaaaaaaaaaaaaaaaaaaaaaccgcaccgcagagaagcggggcctgggtccgccacggacgaaagtgtcttcccatcagcccttgcgctgcgccccggggaccctgacgaccctgattcgagccgagggtgcgcctcggtccactaggggtaccccaaagcaggcagatggctcatgaggggaaggtgaggtacctggggcagccaaaagaaaaaaaaaactgcgccgcggagaagcggtgcctgggtcccccacggacgaaagtgtcttcctatcagcccttgcactgggccccgggaaccctggcgtccctggttcgaccccatggttcgcctcgggccgctaggggtaccccaaggtgggcagaaggcccatgaggcgaaggtgaggtttgagggaggagaggtgaggcacctatggcagaaaaaataaaaacgcgccacggagaaggggggcctgggtcccccacggacgaaagtgctttaccattagcccctgcgcttggccccgtgcaccctggcgaccctggttcgaacccagtgtgcgcctcgggccgctagccgtaccccaaagtgggcagaagcccatgaggggaaggtgaggcacctggggcggagaaaaaaggaaaaaacctcgccacggagaagggaggcctgggttccccacgaaagaaagtgccttcccatcagacccggtgctaggccccagggaccctggcatccctggttcgagcccagggtgcgccttgggccgctgggggtaccccaaggcggacagaaagcccatgaggggaaggtgaggcacctgtggcagaaaaaaaaaaaaaccgcgccgcagtgaagctgggcctgtgtcccccactgacgaaagtgccttcccatcaggccttgcgctggacctcgcggacactggggaccctggttcgagcccagggtgcgccttgggcccgctaggggtacccagaagcgggcagaaggcccatgaggggtaggtgaggcacctgaggcagagaaaaaaaaaaactgtgccgcggagaagcggggcctgggtaccccacggaagaaagtgtcttcccatcagcccctgagctgggcccaggggaccctggcatccctggttcaagaccagggtgcgcttcgggcctcttggggtaccccatggcgggcagaaagcctatgaggggaaggtgaggtttgagggaggagaggtatggcacctgtggcataaaagaaaaaaaaaaccgcgccacacccttgcgctgagccccagggaccctggcacccctggttcgagtccagtgtgttcctagggcggctaggggtaccgcaagtcggacagaaggcccatgaggggaagtgaggtttcaggaagtagaggtgaggcacctgtggcaggtgtccatctgtaaactgtttatccatgtgagccctgatgtccaccaggggctggatgtccccctggggctagatgttcgcctggagcctggtgcccacctggggcctgatatccacgagaggcttagttatccacctatggccatctggagccagaggcccacctgaggtctggtgtacacctaaggcctgatctctacctggggcttgggtgttcatgtggggcctgatgtccacctaagaccatgtgttcacctggagcctgggtgaccatctgggttatgatgttcagctggggcccagagttcagctggggactgggtcaaccttctgcctgatgcacacctggggactaggtacccacctgggctccagtgttcactggggcctgctatctacctggggccttgtatttacctaggaccagtgcatccatctggggtctgagtgccctcatggagcctggagttttcctggggactggggtctgccttaggcttaagtgtacatctgtggcctcgtgtccaccttgggacagatgtccacctggggacggatattcagtaggggcctgagtgtccacctggtttgtgatgtctacctggggcctggtgttcatctgaggtgtgatacccacctggggcctggacatttgcctggaacctgatgtacagctggtgcctgaagttcatctatgcctggtgtctccctggggccaggtagtcaacacagggcctgaagaccttctagagttcagtgttcacctggggtccgaagtccacctagggcttgggtgtccaaatagggcctggtgtcagcttgagatttgtgtatttacctagggcctggttgtccacttggggcttgattttttacttggtttttgtgttaatctggggtctagtgtccacctggggcctgggtatccacctagggactattgtccagctggagactaatgactacctatggcctggtaatcacctaaggctttgtttcacttaggtacttggtgccaaactgttgcctgctgttcacctggggtatggtgtccacctggggtctggatgtcagcctggggcttgttgtatacctgtatcttagatatccagataagggtctgttttctgcttaggtgcagcagtccatctggtgcttgagtgtcaacctaaggcttgatgtctatgttggacctagggttcacctgaggcctgatatccacctggggcctcaatgtccaaatggggcctgatgcccatctgggccctgggtgtccacctgcagcatggatgtccactgatactttatgtccaccaggggcctaatgtccacctaaaacctggagttcacctggggtctgatgttcagctgaagaccggatgtccacctggagccgaggaatccacccagggactggtgttgaactggggcctgatgaccacccggggacaaggtacacaccaggcttgatgtccacctgtcaccagatgtccacctgagtcctgatgtccatcttgatcctgagtgtccacattgggcctgatgtccagctggggcctagatacccactgggggcttcctgttaacctggggactggtgtcattctggggcctaatgaccacctgggttgtattattcacctagggcctggtgtccacttggggcttgagtgtaaccttggacctggcacccacataggattgggtatcagactggccccttggtgtccagttaagacatcatgtgaacctggctcctgagtgtccacttggggccaaatgactactgggggcctgaatgtcaacctagaatctgaggtttactaggggcctaggtatccacctggggcctaatgtccacccgagcctgggtgtcaacctggggcctgatgtaaacctctagttcagtatccacctggggccagatgtcttcctagagacttatattcacttttgacctgatgtccacctggggacttgctatccatccatggtctgatattcacctggagacagatgttcaactgtggccagaagtgctcctggggtctgggcttccacctggagcctgatgtttagctggggctagagttcacatggagaatgatgtccacctgaagtttgatgtttacctggggcctgatacctacctggtgcccaagtattctcatgtgcctaacgtccactagttggcctggtgttcatctgagggcttggtgtcaaccagtggctttatgtacacctggattctagtgtcctcctggggtcttatgcctaccaggagtctggtgtacctctggggtctagtatccacctggagtctgggcgtccacctggagcctaatgttgaggttagactgagtgtcagcctgaggcctgatgtctactagggcataggtattcacctggggcttgttgtttacctggggactaatgtcaaccttgagcctaggtatccacctggggaatagtgtccagttgcagccagatgtccacctatggcctgaagcatggttgttatcctaaggccttgtattagtccattttcacagttataaaaaactacctgatattgggcaacttatgaggaaaagaggtttaactgacccacagttcttcaggcttaatagggagcatgactgggcgggctcaggacacttacaatcatgatgtaaagccaagaggaagcaagccctttttaccatgtgggaggaggagggagacagaatggggatgtgctacacactttcaaataaccaggtctcgtaagaactctatcacgagaacaccaagtgggaagtctgcccccatgattcaatcaccattcaccaggcccattcttcaacccgtggggattacaattcaacatgagatttgggtggagacatagagccaatatcaggcctgatgcccgcctggagtcatgtctacctgaggccttatgtagacatgaggcctgggcattcacctaggacctcatgttaagataggggctggagttcttttggtgcctagtgtatacctggggcccagatgtataactagagcctgatgtttcagatggaaacctgggccccaggtgctcatcagatcccaggtgaaaactcaggcttcaggtgcacatcagactccaagtggacacataggccctaggttgataccaagatttcaggtagactctgggtcccagaaaaacaccctgccctaggtggacagctgaacctgagtagacatcaggccccagattgacatctggcctcaggtagattccttggcccaaggtgaatactcagtctccagccctaggggaattcagtcttaggtgattaaggactggcgttcctctggggcctcatgtctacctgggccctgggagtgcacatggagccagatgtctataaagggcctgagtgtccactagggcctgaggttcaccaggagcatagacatccacctaggacctcatgtccacctaaaacctggtgttcacctggggcctgggtgacaacctgggatctgatgttcacctgaggcccagagttcagctggtgcctatgtcagcctggcacctgatgcacacaagaggactaggtgcccacctgaggactggtgttcatggggaactggtgttcagctgtggcttgatgagcaactgggtcctggtgtcctcctggcaactgatgtccacctgggactgcatgcttacctagggcctggtgttcccctggggcctggtgtgcccctgagatctgggtccacctgggcctagtatccacttggggcctcatatccatctggaacatcatgtccacttggggccttgtagttacctagggactgggtgtccttctggcacttgagtgtcctcctggggcctggggttctcctggggcctgggtgtacatctctggcctgatgtccaccttgggtggatgtccacctggggacagatgttcgcttgtggcttgagtgtccatctcgtgtctaatgtctacctggggcctggtgtttgcctgaggccttatatccacctggggcctgggcatccatttgaggcctgatgtctacctaagacccggtgtttaactggggcacagatttcttcctggagcccgacgttcatctggagcctgaagttcacctgtgcctgttgtctacctgaggcctatgtgtcaacctagggcctgatgaccaccctgagttcagtgttcacctggggcctgacatctgcctggagtctgggtgtccacatagggcctgatgttggcttgggaccaaagtatttacctagggcctgggtgtctacttacagcctgacttctacatggttcattgtgtcaacctggggcctgatgtccacttagggcctaggtaagctccttatgactaaagtccacatgggggctgaaaccatctcagaccttgaacctagggcttagtgtcgacctgagacctggtgaccccctggggtcaaggtatccaccttgggcctgatgaccaactggggtttaaggatctacctagagactggtgtcaacctggaacctgatgtccacttggggtctggtgtacaccttgggcctgatgcccaccttggcacaggtgtacactttgggcctagtgtgcacctgaagcctggctgtcaacctgggtcttgatgcacacctttagtcaagtgttaaactggggcctgatgaaatactggagcctgatttacacctgtgtactgggtctccacctggggcctgatgtccacctgcagccagatatccacctggcaccagatgtctttgaggaatctgggtgtccaccttgaaaatgatgtattccaagagactaggcatgcacattgggcctggggtccacctgggtcctgatgtctacctgaggctggtattgaactggggcctgtgtgttcacttggagcctgatgttcatttggaacctggtgttcacctaggacatgggtatccacctggatcctgattttcaagtggggagtggatatagacctgggaactgatggccacctatgctataagtaacccaaccacctggggcctggtgttcacctgtggcctgatatccacctggtacctgtgtgtcaatctagtgcctggtgtccacttgaggactaggcagacacctggggcctggtgttcatcttgcacccagtgtccacctggaccctgtgtatcaacctgtggcctaggtggccacttggagctttacgtgcacctggggcctgagaggttcctaggatctgatgaccactggggcccaggtatccacctgggatatcaggcttcaagtgtacacccaggctccatgtggacaccaggccaggagaacgccagcccttatctgaacatcaggtcctagatggactcccaggctccatgtgtacatcaggccccaggtatacacgggactccaggtggacaccagcactcaattggatacacaccctgaaggtggataccaggccccacgtgaattcctacactccaggtgaacatcaggtcccaagtggatacctggaccccaggtggataccagtctctaaattaataccaggcctcagatggtccttaggagccatgtgggcattcgtcatcaggaagttacctaggcccaaagtggacatcaggccccatgttgacacaagatctagttggaagtcaggcaccaggtggacacccaggccctaggtaaatacttaggtcccaagttgacagcaggccctatgtgaacactcagaactcaggtggacatcaggcctcaggtggacatctgagttcatctggaacctcgtgttacaggccccatgtaaacaccaggccttaggtggatacccaatctctaggtggacatcagagctcagattgacacaaagactccagtagacataatgtaccaatgaatatccaggcacccggtaaatacccaggccccagattgacaccacggtctatgtggacacacaggccccgggtagtaaacaggcccaaggtggacactggactggacatcaggtcctaggttgacaaccatgctccaagttgacaccaggccccaagcgaacatctggccccagctggacactagtcccctggtgaatacctagtctcaaggttgacatcagaccctatgtgaacactagaccccagataaacacttataccctaagtggacatcaggcctcaggtggttacccagtcccaaggtgaacatcaggaccccgatggcaccagttatcaagtggattcctaggccccaggtgaatatcaagccctaggtggataccgagccccaggtggatacctggatcctggtagacatcaggtcccaagaggacactagaacccaggagtacattaggccacaggttaacacgaaggccccagatgaataccaggccaacttgtggacatcaggcctgagaagggtcctgtggacatcaggcctgagaagggtccaggtggatatcaggccccaggtgaacatccagcactcagatgaacattaagcttcaggtaggcatcatgcctcaggtgaactccaggccccagctgaacatcaggccccaggtggatgcccagaatccgggtgcacatctggccacagttggacattcaaccccaggtgaccatcaggccatgggtgaatacacggtttccaggtagacatcagatcaaaggggaacatcagtcccccagtggacatcaggcccaaggtggacactcaactagaggtttacatcaggccacatgttgacacctagtcccaggtggacatcaggccccagctagatagatacctagtcttccagtgaatttcagacaccaggttgacattcaggcccccagtggtcatctggcctcatgcgaacactcagaccccaggtgcaaatgatgtctcaactggataccaaaccccttgtttgataaccaaggcccaggtggacaccatgtccaaggctgacactcaagccctaagtgaataccaaactctaggtgaataattcaacccaggtggtctttaggactcagctggataccagtccccaggttaacacaaggcccccagtgggcacctaggcaccagctggacatcaggccctatgtaaatacccgggtctcaggtgaacaccatgccccaggtggacatcaggcactaggtgaacacggggccacaggtggacatctagcccctgggcaacatccagccccaggcggacataaccatttccatggataaaccattcccaggtggatatcaggcctcaagaggatggcagtcaccaggtagacatcaggcctcagatagacaccaaggtcccagatgtacagcaggccccaactgaaccccagactcatgtggacatcaggccacaggtagacaccaagccttaggtagatacctaacttcaggtagtcatcagacccaaggtggacacccagtccccaggtggacagtcaggccccaggcacacatcaggccttaagtggacacccaggccccaggttgatatccagttcccaggcgatcaccaagccccaggtagacaccaggccgtaggtgagcaacaggatgcagtaggtcatcaggccacagctggataccagtccccggtgatcacaaggccccagtgggacatagatctaaggcagacatcaggccccaggtggacatacagatctgaggtggaattcaccctgagggggacattcggccccaggtacgcatcaggcctcagctgaataaccagtccccaggtggacattaacccacaggtcaaccacagtccccaggttgatatctggtccccaggtggctactcaatctgcagggtaacattaggcccctgtaggatcccaggccccaagtggattcctaggcccctggtgaacatcaggtgcaggtgtccaagtaggccctgggtggacataactgtgtacaggtaaggagttgacctgtggggaggatgagcagtcagcagcccactggggtcctgagtaggtcttctggaaggaggaggctgaggggatggaaccttaaagaagcaacctcacttccttggcaacagaccctaacagaacttagaattctggtaaccaggccaggcacggtggctcacacctgtaatcccagcactttgggaggctgaggcaggaggatcatgaaaccaggagatcgagaccagcctgaacaacatggtaaaaccacatgtctactaaaaatgcaaaaaacaaacaaggtcaggagatcgagaccatcctggctaacacagtgaaaccccgtctctactaaaaatgcaaaaattagccaggcgtagtggtgggcgcctatagtcccagctactcgggagtctgaggcaggagaaaggcatgaacccaggacacggagcttgcagtgagcccagatcacgccactgcagtccatccagcctgggtgacagagcgagactctgtctcaaaacaaacaaacaaacaaaaaacaaacacaaaaaaactagccaggtgttgtggtgcgtgtctcgtgcctgtaatcccagctactcaggagactgaggcaggagaattgattgaacccaataggcggaagttgcagcgagccgagatcatgccactgcactccaccctggccaacagaatgagacaatgtctcaaaaaaaaaaaaaaaaaaaaaaaagaatcccgataaccaggcaccaggcacccacatcctagagttagacccatagccagctcacttggtgggagatgctcaagagagcaagatgttcttgtgctgcatccccacatctcaagtctcctgcttcaggaatggcaggagtgagagcctttcttttccaacgatgcccttgtaggctcatccctcaccccagatgtctctggccatttgacagaaggcccccccaggtaccacaggacaggagtcaccaggtagacatcaggccccagatggagctaccaggccaggcctcaccagtgatcccaccagggccacatctgcacattgtccttgtccagctggagcctctggagctcattgagacacaggcacatggtgaggtcacctgcagtctggaagtctttccagggacaatgttttcaggctgaaattcctttaaattcagtgaggttgttttcatgtttggaaattccagtggaaagtgagtgatattggtgacctctctcctttttcagctcctgcttcaggtgcagaaacacagctatttccagtgccagctgttgagccagtgccagcaccaggggcagagccccttccagggacagcgctggagctagaggaacctccagagccttcctgccgctgccctgggactgcacaggaccagcccagtgagaagctgcctgacttcatggcacctcctgtagagccaccggcctcagccctggagctgaaagtgtggctggagctagaggtggcagagagggggtgaccagcacagctccagccagcagctcccacactgctcccagtcctgggcacagtggaagctatggaggcagagaccagggtgtgcaacctgggctcctctgcctcactggagagggacttctctcattcagcagagcagcagccctgctgctgaaggccctgctgctactgctgctgggggtgtttgcctgcctgcaggaggtgctggagagcaagaaaaggagcctgtgagcaggggttccagcaggtcctccggctcccagaggtgacctcctcctccaggaatggaggtttgccctcagctgggcatctgggccatttgcctctaatgtgctgcccaggatggcctcttcttgacaggtggacaggggttgagggggccagggggcatctccaaaggaagctcttaaactcagcagcagcactccagaatctccatgcctgcacctgcccaaggatttattcatagcttaactaagaatttcaaatttctaccataacactgaaataaagtttgactttttgaaacttctatgacttctttcactccctaatattgtagatggtggttttgaggtgacgttgaaaacctctgatagttgtgtgttttgttgtggttctttgggtgactaaattaccatctgatcaagtgatattgaaaacccttcaggtatggcttttagaagactttgacctatttttgcttgtgttgactctccctccagctttgtggaaagagggatcatgtaggttcaattctcaggcagatcagtcaccttttgccatcaaagttttagcatccatttcgaaaatttggtgtacaagttgatattttggtgtttttagctaatctggggtcaaaacagaatgccatagatgaggaagcttataaacaaatttgtttctctcagttctggagatggcaaaattcaaggtcaagtggttagcagattctgtgtctggtgtgggcttgctttgtggttcatagccatgtttctaccatgtcctcacatgacagaagagatgagggagctctctatggtgccttcaataggggctactaatcccactcttgtggtccctgccttcatgatctaatcattccccaaggccctacctccaaatatcatcacatagggaattagatttcaacacttgaatttgagagggacaataacatttggtctatagcatcaggttacccagagccttatgcattcggaggaaatccaaaatcttctgtaagtatttgctggtcccctctgggcttagggaaatctttaattgcagctcttgattcagcttggtccaagccgaaattctacgtttgcctgggtaacttgttcatgggacagagggaagtatagaggcaactgaccatttggagttttaggacaattgatggaagagggcttggcatctggatgagaagtggagggagaatagaacaaaggcacagaaggagagagcacagtgagaaaggggaagagggacatctggacataagggccaactggagggcagggaaggtaattttccttgcattttaaactcagaccacatatcacatcagaatcacctcagggagacgttttcaatgcatattcctgggtttcttctcttggaattttttattaaatcttgagttgtgctgatttatccatatttatcataagaattttggataattcttactttgagaggcccaggcagtggatcacttgaggtcaggaattcaaaaccagcctggccaacatggtgaaacctcatctctactaaaaatacaaaaattagccaggcatggtggtacatgcctgtagtcccagctacttgggaggctgaggcaggagaatcacttgaatcagggaggcagagatgacagtgagctgagatcacaccactgcactccagcctgggcaacagtaagactccatctcaaaaaaaaaaaaaaaaaaaaaaaaagaattgtggataattctgatgcaattagaaaacaaagcagagcttgacaaccactgggttgggacgtatatcaggaagacatttgattatgtaaaataactgcaaaacaaactgaaggggaattattttaaaatgcttgaatataattatataattcaactcttcttatgtatgtagtttgaccacatatttgatgtctgctatactaagattggaaatgtgtagaagtttttttaaaaaatcaggtagaagcacagaaaaaaggagttggagagaaaagaaaactagctattgtctggtaacaagagaagagaagggaaacgaagtagcatatttttgttcattgatggcatctaaattatgatcccaaatatttttttcctaagaaatccaataatacaagtattcagagtggagtaccaacactgatttactgggaaagagaagtgtactctgttttgctacacaatgttgagggagaaggaaaggaaaattatttgagtaaacaagtaagagactggtcctcagggaagctgtctgcctgaaaaatcacaactactgcacctacagataagccctgaacagataagcatgcagggtccagcacagatgccttctgttctttgtgtatttggcaagctcccaggtaaaattttcctccctttttcaggcatatacttggcggtctctgtgggaacttgcgcagggaggaggggggcttacctaaaacaaacccacagttacagaaacaagagaagcccactttgtgcttgactagagacatacccacagctggatatataaagggaattgtgccgacagttttatatatagctgagaggagtttcttataaaagctttttgattcaactgtaaaaacggcaatccacttggacgcccttgtctgctgcagagagcttcctccttttgcttgttaaactttcactcccacctcacttgtgtgtccccgtcccttaatcatcttggtggtgagatgaagaacgccaggtgatacctcacaagagagactgctacgttgtggtgcattggcgagactgcaactttaagaagtgtgacttttattgctgctgaattattttatctcctacccaattgaaaataaaggatataaagtgcttaggttgaacacaaagtcctctgctctaggtaacatcttcagcagccacattagcagaggcatgggtggtaatggtggagtagatgtctctttgcttctgacagggtgtctgcttatgtgttaaacaaaatagtatggtatatatttcattaagaaatctgctaaaaaatgaagtaaaacaggttcatgttcttaagaggcacaggatttgctacggcagcaagaccaaaaggcttaagtaacaaaaatgtgcatagtagttacaaacattttcatctaaacaaaacaatgtgagcatctgcatatgacaataacttatgcaaaaaaatatttttaactgagattgaaatcattttatacataacaaatgttatcactgtattctcaggtaatatattgtttgtatatagatgttataaataataacttatttaagttattcatcatttatacaacaattaattctttggaatctacaaaatgctggttttgttctaggcactgaatgtacaaattgatttaaaatatgtgttcttagagtgtggtagattaaaaaatacaaaataggccgggcacagtggctcacacctgtaatcccagcactttgggagtccaaggtaggtggatcacctgaggtcaggagttcgagaccagcctgaccaacatggtgaaaccccatctctactaaaaatacaaaattagccgagggtggtggcacaagcctgtagtcccagctactcgggaggcagaggcaggacaatcgcttgaacccgggaggtggaggtggcagtgagccgagattgcaccattgcactccagcctgggcaacaagagcaaaactctgcctaatacatatacatatattatgcatagatacatatatacatatgtgtgtatatatatacatatgtgtatatataacctatatacatatgtgtgtatatataacctatatacatatgtgtgtatatataacctatatacatatgtgtgtatatataacctatatacatatgtgtgtatatataacctatatacatatgtgtgtatatataacctatatacatatgtgtgtatatataacctatatacatatgtgtgtatatataacctatatacatatgtgtgtatatataacctatatacatatgtgtgtatatataacctatatacatatgtgtgtatatataacatatacatatgtgtgtatatataacatatatacatatgtgtgtatatataacatatatacatatgtgtgtatacatatatacgtaatatataatatatgcatatgtattatatacatatatacataatatataatatatgcatatgtattatatacatacatacataatatataatatatgcatatgtataatatacatatatatctgtctaatatatatacatatatacatatattaaatatatatacatatatacatatattaaatatatatacatatatacatatattaaatatatatacatatatacatatattaaatatgtatacacatatatgttagaagttgtactgctgaaaacaagagctaccaataaaaaaatttcaggaaacctagtgtgattatttttaatagaaatggatattttaatacaggtctcttgttttttcttgtggaaataaatgacaagatggaatttctgggtgtttggtatctgaatatttaagtatagcaggtatggtcagtttttcaaaggcattttaccatcttacttgtccatcggtaactcataagatatgtggaacaacgtcctctccaacaacctctagtatcagtctttgtaaagtttgtcaattaaatgggtgtttttttgtttttgtttttctttttgagaccgtctcaccctgtcacccaggctgtagtgctgctgcgtgatcttagctcactgcagtctttgccttccaggttcaagtgattctcctgccttggcctctcaagtaactgggactacaggtgccccccaacacacccagctaatttttatatgtttagtaaagacagggtttcaccatattggccaagctgttctcaatcctgacctcagatggtccacctgtctcagcctcctaaagcgctgggattacagtcatgagccaccgcacttggctggttttctctctctctctctctctctctctactttaagttctgggataaatgtgcagaacatgcagttttgttacacaggtatacatgtgtcatggtggtttgctgcaacatgggtgtaggttttgcaggtaattattatattattaaaagataacagaatacctagctaaaaaaaaatgcgaggaggcattgatgggcacatgtttactgagcacatcctgactccagaattaaaaatccaatttatgcctctgcagtccaataaaatttttccttaagaatccagggatcagactttcatctcagcaaccactccaatatggtttctcacctactcattccaacgagctgctcatatcaaaatataagtgctatccatattgttaaattataaattgaaccataacttctcagccttcatcttaatttatatatcagcagcatttcacacagtctatctccaccttctctttgtaaaacttttttatagaattccagaacacttaacttactttccccccaccacgtttttgaaaattacccctagtccttttttgcaggtttcatctttactatttttcaaatgttagaggaccattaggctcaggaatttcacttcttatctttcttatctttgctttcttactaatttttgtgtcattaatttcctgatatttcatattacacctaaacactggacactacacccaacactccctgacttatccacgtggatgtcagttaggaatctcaaaattaatatgtctgtatggagccactgaaactccccaaatttgctcttccccattctgtttaatggcaactcccattttatagtttctcagctcaatattcttggtgtccccttttaattctgtctctgtagctctgtcactctcttcctgtatctgtctgattctctccctctctctcctctctctcttgctcactctcactcttgctctctctccctgcttcacacacacacaaacacagacagacacacacacacacacacacacattttcagatctgatgtgtatggaattcctgccagctttacctttaaagtgtaataattccaaatgttgtttccaaattcacattcccacccccaccacttggtaactatagcgcttccctcacaaggccaagtgcagagatttcttggggaaataatgagaactattatacattcttatttcaaggacccttaaaattataggattaccatatttgatactaatttaagcttctgtcattgcccttttttaaatccagtctccacacagctaccacagtgtgcaagtagaagtctcagccatatcaccacactcctgctttaatgtccctactccattgctgcttttctccttcagaagagtttaagcttaatgaagctgggcaactttacatatttttccacgagctggagatcacttggtgtaaggtaaaaatgatcagtaaatattttcaaataacagaatccatgaataatagttttgtttctttgagagtacattaacttttaaaaatcaagaaaatagattggtcaagagaattctgcttgttttgattttgttatccctcgattagattaactgtgttagtataaatgtcagtgtggaaagctataagcatttcctaaactttaaaatgaaaggcatggaatttaaatatctgctccctttattcaaacaaccaaaaaacacaactttttaaatatattttatgtatgtatgaaatctaaatttatttttctctctttatccctgaatactttttaaaattattcatgtcctcattattttttaatccacttcagtcacattttaaaatatattttcgacttcattaagaatatctttgtgttccactgaatagattgccaaataataaaacattagcagtataatttcctcataaactttatttaatttgcttggttaaacatagatttcctactctcaactcataatttcattcaataagaagtataatatattctacttgacatttgcggggttttcataccatgcatttgtcattgaaattggtttttgatatttgaaccactagtttataattgtattgttagttagactggtctgtagaatctttcttcgttttgattctgtggtttattcattatggagtagctgtgctattgtaaattttgaggtcaaaagcttaaaacattttatgtattttcaaacaaagtggatggcatttaaatatctattccttaaaatttggaagaaaggttaacaccatataaacccagagcctgttttttagattagtagcacgtagacattttcaatttcttctaaagttgaaaaaaataaacattttatattcatagaatgcttgatgaaggtaaatatatttaattttcacttaaaataaatttggttacattgaaaggaaatttggctaatgtaagttagatacatttctaattaaaacaataatttaagataaataatgctcaaagaacagtggtcactgcatttattccagagagaggacatttatcctgatctgactgtaataacgtagtaggtagaactgctggcgtcgacacccaagcaaggaagggaagctggtgtctcaaggggtcccgctgagatggaaagggttcagggcccagactgttgatgtcgcctggacccaaccaccatgtctcagaagaagaaatgacactcccctcctggtgccaccccaaacaaggagcttagcagtgttgcacacaggacagtccttgcaggagacacgtttgacaagttgctgaggtgcctgatggggccaggctttttttcatgaaatgagtttgcatcgtgaggaagcctttttattggaaacctggcaggggtccaatttcccctttgccttaaccccgtaggagcacagtagacagggaggaggtcacccaggtggctgttcctgcttggcccccacttcccagaccattccaggcagggagagccgctgagatcactccatgggctgctcacatgtggtctggacgcagccgccctcctgtgcctggcaggcagcctctgggccatcagaggacccactgtgtggtgatcagtggcccaccacctgcccttgtggtgggtgcagttcacaggtgctgccccggtcctggcacactggccttcccagcctggcccaggataggggatgtgaatgatccttgcctgtgccccttcagaccatgtgaggttggacactcactgcagaagtccctccaggtcccttttcaactgagttgtgggggacttgcttagtcctcatgcccagggtcaggggaggggtgcagagtctgcaccctaaatcccctggggcctgagggaggtctcccaggtgacctctgtcctctccagtgacatgagtcctcccagatggcctcagccctctcaggtgacatgcttccatggtgactctggctcttgcaggaggtgggctactacagggacatgagctgcctaactgccatcctcctcctgtatctgccagaggaagacaacttctgggcactggatcagcggatggctgaggagaggcactccctgcagggtaggtggacagctacccccagggcctcacacagccgggccatgggacggccaccctggctgggcgatcctgacttccaggcaaggcagtttccttgctttccagcttgttaggagccttcaggacatccctgctgggggtcccagaggggcccatagctgaacagggaccctttcacttcaaggcggacacctttcattcccaacagcagagggcgctgcagcctccccctggccaccctgtgtgtcccagagccacagccctctagccctgagttcatgcaggtgactctcacttccccaagagtcctcctacctcccagctggccacactcccagctgcccccctagcccacagatgggccaatgaagtcaagatggcagtgtctgcccatcccatgtcccctagccagaccccatgtccaggagatggccatgtagtccttcagcacccacccggttccctccactagccactgcctgccccagccctgcctcacagcctcaaaggcaggcctgccctcctggcacctttacccaggatgctgctgtgcagtgcctccagctagggcccatctccctagagctgagaccacatggtagggtcacctgatggaagggaggaaggcctcagggtccggggtcccctgccactgcccagctcttccagctgatggctccacatcttgggagtgggctctgatgcatgatgggtcaggggcttctcaggtttctacagcccaaatactgcccagctccggaggctcctatcccaccaggagtaggtataacacaaatccttcccaaagatcatgcggtacctgctgagtggatgacaccctcaactctttcccagaggcccagggtcccatggggcagggaaacaagggaagatggagctcctcgagggcctgacaaggggctgagtcccagccagggcctcacccaagatgaggattctccatgggtttggagttgggtttccttttcctgccctggaggaggaggcagaggtactaggatgggggctgagctccagctgagcagggttaagggaagtgtgtccaccaggcatctgtgcatgggggagttgttgggaaagcactggccactgcccagtgttctgccccagggcagctcagggggccctgagcacctagggtccaggaagtgccgtgcattgaggtttgttgagttggctcctctggtgttttgctgatggggtaaggaggcaaatggagaccccaggccagggactctcctgtcccacaagtgcccagctcccccaggaggacctggctcaccccaagccagcaggaagcacaggaaagtttctgcatggcacagaagccaggccctcctcaagagggggcatcacactgcaggtgtcaggactcaggcccactgctatttccacattattaattttataaggtgatatggtttggctgcgttgccacccaaatctcatcttgaactgtaatttccataatcctcatgtgtcctgggagggacccagtgagaggtaactgaatcatggcggcagtttccccatgctgttctcatgatagtaagtgagttctcatgtgatctgatggttttataagcagctggcatttcccttgcttgaggtgatgaatgccccatttaccctgatgtgattattacacattgcatgcctgtgtcaaactatctcatgtaccccataaatatatacacctaccatgtactcatataaattaaaaataaaaataaattttttaaaaaagtgtgagttttaaaggtgaggtttgccctccagcgctggtgcctgccaggtgtgaccttcacatcatctttccacatggtccaggtccccatctgcagaggccaacagttcccagagtgaccttcctcagaaaacagggtcttggaggagacagtcagaggagggggcctcgtcctccccactgcacagccccttgtggggattggaagtgagggtctctgcccacaagttggcagtcaccctaagctgttttgtgggaggaagcatagggaatataggtcagtgctggaacagcatttcctgatcctgacttggagaaggtgttaaaatcttgacattcccgactcctcctttgtgagagcccctgtcctgcaggtctcacagggttgttgtgagggccacctgtggtgatgggtttggaagtgctttgtgaatgacacagtgggccttcctattcctgtcattggcctttcgaccttcaatactaattgcctggggatctccaggcctcaaggtctaatcctggaagggtatgagatgtccctagtggaatattctacacctcctgggaggtctctcacttcaaccttcacctgacataacccctgctcctgttccctcaacctggagagcttgcccaggagcacagggtagtactggactgacctctttggaaagggtgattacatcctcatttcagctctccctcctcctagttttccacgtagaaatccagggctccatgcagcatttgctggacatgaggggaaaacttttagggcaggcatctgccctgggtggggacagaggagtatcctggagtctgagtgtcaggagtgtgagacctgcccagctggccagcccctgtccccatgctgctcgatgcatgatgtttcctgcacaagcttcctttagagggaagcttccggagtgactgcagtgaggtccatgctgttgggggtgacagagcagccctggaggccctctgctcttaccctggcaggaggtggccaaaaagaagcaggcagaggaagcttctccaacacgcttggaaagaaatttccacatatcactcacgtcactcttgccactagaaggaaaatttctacagtggagtggaagaaaatgactatgctgtgggagagaatggatgcatccagaagagcaaggggggagggaaatgtgcccattgccagaattttgtgtcttttgaagacatttgccagaattctacttttgaaggctgccccttttgacagtcagttactgaggaagctgtgggacattttcaaagccttttatataaaaaaaaccacacaatatactgctgtgggtctgtgttcagggactatgaagagcacagctgccactgttctgtgtcgcagatgctgtgggaagtgccttaacacacagaggtttgcttcatgcaaccgggtgaggaacatctctaaaacattttacagtcaagaaaattcagtgttcaggaggttgaatgcgttatccaagatcacacatatgtcctgacagatttggggttcaatgaagaattatgtattttaattaagaattatgtattttaattaataattatatattttaatttcacattttaaatttctgcagttttcttccatcacttttcaccatgctttctacacttggaattactttttttggcttcttgatcttctttacttgtatgttattgattttctacaagttttaacatatatgattaaagagtatttcttaatgttttaataattatcctagaataaaatatatttactttgatgtatgcattggatattacagtgtattgtgtacattttcaaacactttgtgttataccagaagcattattcaacagtggtcatttttttacctgaactatgttcagaaaatctttccaccacagtacaaaaagatcgacttcattttgttaacagatggatgtgccatagtgcaattaactgtttaattatcctgttatcctgttgtggatatttaagttcaaacaatgcagtaataaatatgcaagagtgcttttagacattaaacaatatggctctaaattagggacctagtgcctgtaatcccagcactttgggaggtcgaggtgggtggatcacctgaggtcagaagttttgagaccagcctggccaacatggcaaaaccccgtttctacaaaaaatacaaaaattagctgggtatggtgatgcgcacttgtagccccagctactcgggaggctgaggtaggacaattgcctgaacccacgaggcagaggttgcagtgagctgagatcctgtcactgtactccagtctgcgggacagagtgagactctgtcccaataataaataaataaataaataatctagaagtacaattgcttagccaaatttcttatgcattttgaatgataagagttgctgcctcatttctgttacaaaggctatggtaatttacgctcaaaacacagaataggttggttgttgtcacatatggagtcttactgttgccgagactggagtgcagtggtgtaatcctagctcgttgtagcctccaacgcctaggctcaagcaatcctcttacctcagcctccctcccaattaactaggattacaggtgcatgccaccacacccggctaattttattcttagttatgggatcttgctatgttgcccaggctggtcttgaaatcctggcctcaaggtgacctcagcctccagtgtagctgacattacaggcgtgagacactgtacctggctgaatgagtgcctctatcctgacacttgtgtccccacgggatcctgcagaattcaggaccctgtccacacaggggaaaactctctgttggggtcctgatgactgaggagggagcttacccatggctctcctggtcatttttatttaatagtgagcacagaacctcacattttctggaatgttcccatatgattttgtgagagaaaagagaatagagaccccaaccccaagctcactgtgtcaaagggaaaattaagcttgggaactgagttacgcaatactgccttccttgttctcaaacacatagctataacttcacaaccctgtgtcatagcctcatccataagccaggttcacacagtgacagaaggccgcatgtctcctcagatgtcctccctcacaatttgctgtgaacccctaaatctttcagaatgcacatcccaccttaaactatccctaaaagtgggtcggctcaatttcaccctgacaatctcaattaccagcttattttcatagttctgggacaaggtcaggaccagaaatcatccctctgcctatcctgagatgaatgaatcattgagttttcctctactccactccctctattcacatgcttactttatcttatgtaaaatggagatttactgaatgtgagatgaacgcataactgtttcctctgctccctcctttcctatgtaaaatgtagatatcctgatgctaatcagagccacacaagaatgcaagcatttgcttcactgcctaccttcagtctcgcgggagttctctggatttcttgtatcagcatgtggacctctttagcaagattgaggacagtttcctcaattatatcctcaaaaacgttttccaagttgctcactttctcttcttctctgttagaaatgccagtaagtcagctgggcacagtggctcatgccagtaatcccagcactttgggaggccaaggtgggaggatcacccgaggccagaagtttgagatctaactggccagcatggcgaaaccccatctttactaaaaatacaaaaattagcgaggcatgctggcacacgcctgtaatctcagatacttgggaggctgaggcacgagaattgcttgaacccaggaggtggaggtttcagtgagccaagatcatgccactgcactacagactgggtaacagagtaagattctgtctcaaaaaaaaaaaattccaataagtcatagattttgttcctttacataatcctacatttctcaaaagtttggttcattatttttaaattctttttttatttttgtctgactgggttgattcaaaggtctggtctttgagctcttaaattatttcttctatttggtctagtctgttgctaaggctgtgaactgttttttgaaattcctatagtaaatttttcaatgcaagaagctctgcttggttctttctcaatatggctatgttgtcattcaaatccaggatcgttgttatggggttgttgctggatttcaactttctgttggcttttggtgattttttttgccacttatatcttgagtactatacctgtcatttcagacgttgcattctggttaggacgcattgctagattgctggtgtaatcctttggaggtgatggaacattctggctttttgtattgccagagttcttgtgatggtttcttctcatctgagagacttgatgcttcctttgttgaatttgctatcatttggaaggagtttttttttaaatttttcattctttctttctcttaagggtatgactgtggtgtatgttgtataggatcattttgcttcatttctgggtactttcagaggaccaaggctctgtacaagttccttggttgcagataggctcctgtggtggcttggtgtggtgatgtatttttgtttggtggtgtaattcaggcttcagtccagtagacagtgcttaagagtaacagctggctgcagggtcttctcctctgtgtacttgtcctcgacaggtgcagaagtgacaaagtgccaaaagcgccctgtcccagtgggtactagtcttcagcaggggcagagctgctggagaaacctaagaagcagcctctttcagcccacgttccttgggtcccaacaggatgaccactgctggatctgcagcagtgcactaggaaagggacagagggcaagagatgaccacctctctaaatctgttcctaggctttggtgtgcccctttcagcagctgatatcgtgatcgtgtttcctttgacccaaggggtggctttggcaagctgtattcctccttcccttagggctggtcctcaccaaagtttaggtctcctggggaatggggttcacctccctcttgtttcttggaactgatggagtactctctcaactgaccaagggagcaggctgagacacccagcaatgacacacacagaccagttccaggttgcaaagctgttcttggctgcaagtctcaccatccttgagaaacctctgctttagcaactctcttcccactacagtcctgcaagaggaaagagcctaattccaacacttactgctggagcactttccacactcaacactcaattctggctgttgaggctgctcccctgctccagagcaagcactccaattcctagcccaagattaaagtgtctgcagtggccaccattgccaggcaccaaaaaatgattgactttgtatgagcccagattaaaaagggcatccttctctcagtcccaggtctgggtaaatgcctgcagcttttctgagtgtctttcctctttccccatctctcagccacttttttgctagctccaaggcttgggagaaacagagtgttctcccttaatctggattgcacaaatccccagtgaaaaggtgagttgcagagggagactggctgctcttctctcgtactggagtttcactcccttctatgaaccaaatgctatcacagagtctgctttcccacctccccgtccacagggtctggagtgttcttctctattcctgtgaattcctatttttcttcttgaattgaagctcacaaagtttatctttatgcttatttttctacttccaagtggctgaggcacattgaaagcccctaatccatcgttctaggaaaaaaggatggtttaaataaaggaatgttcatataaaatatatattaattagtgcaaacatattttatttgacatgagttaggtgaatctttgatacattaattaattttaaaattgttaaataaaattagaaatatcttcgaatttgccaaggtatgtttctctcctgggattactggtcagttttattttttccttggatagacattttaagccataaatcttgacatagacctgatgtagacctccatacctttcccagatgtgggacggagcaactgggacaggtccatcctagcactaagggatgattaaacctaacttgtagtcattgtacaactataaacatggttgatgctttaagagaaagatcttgatggaaagggttaaatgtaaaaattgatcatatgaattgggtcattcttatcacaccaaataaaaccatcaacgagccagggggaggaggcattcagggcaaaaacaccactccaaaagcgtaattctctgcatgcctggctgctgaaattacctgctttaagctgaaaccagttttatcaaatggttactgaaacaacctcttgaacactaagactagctttacccaccactgtccctcacctatcagagcctgccagctctcaaaaaccttactggtgccagtgaactttctcaaagagaaatacatactgtttttctctctgtctcccttttttataaaacctctaactttctctttatgttttggacatactaaagacacccattctgcatgtatgtgtgaaattgtaatacttgtatctcaaataaaacattttaatttcagatgtttgtctctatatttatttgactttgacaatctgatattatttagcattatttccagtctcccaaataatgtcaaaattttgttatgttagataggaatatcttgttattcaacttgaaggtaaactgcttgatcaatgcatgtaattccttgacagtttgtcagcacctctaagacaacatgtagatattgctcattattaactcatttcatcttttcatgataaattacaaaaatttaattttcatttttaaaatgcaaaccattatgccttgtattatggcattcttgcattactataaaggaatacctaagcactacataatttatactgaaaaaaaagattgacttggctcacagttctgcaggctgtacaggaagctttgcattggcagttgcttggcttcaagaagggtcctcagggagcttttacacatggcagaaggtgaagcaaaagaaggtatgtcacatggccagagcaggagcaagcagggagaggtgccacacacttttaaacagccagatgtaatgagaactcactcactcttgcaaggacagtgccaagaggatggtgttaaacatgagaaatcagccctcatgaccccatcacctcccaccagaccccgactccaacactgggaattacaattcgacatgagacttaaagggtacaacatccaaactatttcattccatccctggcccttcaaatctcatgttcttctcacattgcaaaatacaatcatcccttctcaatagtcccccaaaagtctcaacctgtttcggcatcactcgaaagtgcagtttcttctgagacaaggcaagtcccttccactgatgcgcctgtaaaatcaaaacaagttatttatttctaagaaaattggggtacaggcattgggtaaacattcccattacaaaagagagaaattggccaaaagaaaggggctacaggccccacacaagttcaaatcccagcagggcagtcattaaaactcgatgttccaaaataatctgctttgaaaccatgtcccacatcctgggaacatagagcattcccatgatgcatagggtgggctcccaaggcctggggctgctctgctcccacggctcttctacactgaaggcatgagctgctggtggctctatcattctgggatctggagggcagcagcccccttcccacagctccactaggcagcccccccagtcaggaccccgagtggggcctccaaccccacatttccacttggcactgtgctagaagaggtcctctttgagagctccagtggtgcatagtcttctccctgggcatccagcctttctcatacatcctctgaaatttaggcagagaatgccaagcctccttcactcttgcactttgctcacctgcaggcttaacaccacatggaagccaccaaggcttatagtttgcaccctctgaagccatgacctgagctctatctgcagccctttgaaccaaggctggagctagaagggccaggatgcaaggaacaccctcctgggggtggtacaggacagtgatgccctggccctggtccaagtggaacaggaattaaaagaaattaaagaatgtgtaagcagaaactcagttgtatgtgagaaaacccagttccccctgagaaagagaaagagctggagccctttaaaaattaactgcctgtttttctgtggctagtgagcttcatctctcctcctttcccaggcattgtgaagaccctgtttccctagctgtgcagctgcaaggtcactagacagataaactcaagtcgtaaaacatgtttttccttgaaaagtaagaaatgatataatgcatgtctcaattaattgaataactgtctttgtttctcacttctgtaatatgcttccccctgcacagatctccccactctccaccaccccacaaaatgcttaaaagttaacttaagtctttgttcaggactcagtcctttggttgttaatctgactgggccggtgcacctaaataataaatatcctcctcaaccccatcagtctctctgattccttaaaaaatcccgctacagcctgggcacggtggctcacgcctgtaatcccagcactttgggaggctgaggagggcagatcacgaggtcaggagattgagactatcatggctaagacagtgaaaacccgtctctactaaaaatacaaaaaattagccaggcatggtggcagtcacctgtagtcccaactacttgggaggctgagacaggagaatggcatgtcccggaatgtagagcttgcagtgagctgagattgtgccactgcactccagcctgggagacagagtgaggctccgtctcaaaataaataaataaataaattaattaattaattaatttttaaaatcccactacacaagaaaccattctttcatcctagacctctaggtctgtgctgggatgagctgctgcaaagatttctgaaatgccttcaaggcctttttttaattgtcttggctatcagcacctagctctttttcagttatgcaaatgtctctaataagtggttgctccacagcctgtttagattcttcccctgaaaatgctttatcttcctttgccaaatgggcaggctgcaaattttctatacttgtatggtctgcttcccatttaattgtaaattccaactttaagtcatttttttgctcctgcatctgagtgttcaaacttcctcagatccctagtacatgaacagactgcagccaagttctttgcaaaggcataacaggcatgacctttattccaagtcccagtaagttcctcattttcatctgagaccgcatcagcctatccttcaccgtccatatcactatcagcattttggtcacaaccatttaactagtctctaagaaattcagaactttccttcatcttcctgtattaggagccctccaaactcttccaactcctgcccattacctagttccaaaatcacttccacattttcaagtatctttatagcaatgccccatgtctcagtaccaattttctgtattaggccattcttacattgctataaagaaatacctgagactgggtaatttataaagaaaagaggtttgaaaagaggtttgtatagctgcaggctgtacaaacatgattctggcatctgcctagctcctggtgaggcctcagcaggctttattcacggcagaagatgaagaaggagcaggcaggcacatcacctggcaaggcaggggaagcaccacacacttttaaacaaatagatcttgcaagaattcactcactatcacaaagacagcaccagggacaggatgctagaccatttctgagaaatccacccccatgatccaatcacctccctccagacctaccaccaacattggggatatcacaattcaacatgagatttagagggaacaacatctgaggtatctcatgcctcatgttgtgacttggtataatgtccataagattacactgactttacacatcatattgcagtttttgctagctcttctgtagtaagaaaatggaattcatcagcaatgccttctaagtctggctctgttttcccatgcagactattccctgagctctgcttgtcagtcttgctagaacctcaccctaggcagcaacctccagtctgagattgcccttgacagtggctgaggtttgcattgttggaatggattagaaaaaacaaagggaagacagaccaaaacagatttaaatacagatcccatttgttgaagttttaagtaattgtaaatgtttatttgcaccagctgcccactcccattgtactctcctcacccaaaaaggtgacttgatattctagtaaaaagccaaactgtgctttagagaaacccacttgttacttctttaaatccatattatttttccaaagtgaatttttcttaatatgctctggcagaatcagtaaactaattatttacaccagagtcacttaacctttcctcttggtcatttgcatgtaaattatttttatatgtataaaatttgcttactcaagaaagctcttgctatatatatatatatatatatttttttttttgtggtatcttaacatactctagtcttgtcttgaattccttaagactttgaggtaaagaactctattgtaacaagtttccaaatcaaagtgggaaagaggaagattaggttaagcattaggtcatcaggtatgtaggacagctaattccattatcagaatggtagtgatagccagtttgcattttgtatattagttgtaacgaaaatattcagcatattagtgacaaaaccaaagttattgtgaatcagtttataatttattttttgagataggatcttactctgtcacccaagctcaagtgcagaggcatgatcttggctcactgaagcctcaaccacctgggctcaagagatcctcccagcccagcctccttagtataggtgagtgccaccacacccagctattttttctctagtttttgtagagattgggtctcactttgttgccaaggctgttctcaaactcctgggctcaagcaatccttctgcctcaacctcccaagtggtgctgggattacaggtttgagccaccgcacctggccagtttataatgttaatggcttttggagcaggaaccagtgggtgctgcttcttgtctgcaagatgaggagtctcctctccccagaagtgaggcatcttctaccacaagggaggctttgcccaaacagtcaccgaaaggcagagattggggagagaacaaaacaggagtgaatatgttcctggaacctaactgctccccaattcaattctactgcagacattcagaatgaaggggacattcagctgaagaacaggagtgcactggctgttaaaatctcagattgtaaaaacaattttgcttcattttccttaaataatttttaaacaattgttcttaggtgattttctaaacttcaggtaatatctgtgacttagtaaatgttctttaaaagatgggataatatttttattttgtttaattatatgtgtttttaaactaattttataggaaaaataatttctttccttccctgttataccaaatacagcctttagctcaagacacaagtaattccaggaaaactggaatgtaagttcaatatgttgcactaagtacatttgaaagtgcatgcatttttattttaattcatcattctcagtcaactatcgctggaaaccatcattcttagcaaactatcacaaggacaaaaaaccaaacaccgcatgttctcacttataggtgggaattgaacaatgagaacacatgaacacaggaaggggaacatcacactctgggggctgttgtggggtggggagagcggggagggatagcatttagcctaaggctaaatgtcgagttaatgggtgcagcacaccagcatggcacatgtatacatatgtaatgtatacatatgttaatgcaccaattctgcatcaagtcagtgcaatcagagacactgcaagaatgacttttggttttcttttcctagtttttgaaagtttctcaagtctgtcatactggactctgtattacatcttgaatttttttcacttactatagatctcctatacgctcaattgtttagctattaccttaacatttaccctgtgaacccatgacatttgaggctgccaaagtgattattacatgataaaacatatactcggttaaaggcaatatttaacaattgtaaaaccaataaatcaataattaaatctttctggcttagacttaaaactgcttaatttagtcatatctctacccacaatatagggattccagcaagggttgaaagtagagttggcaagcatttccattctcttctgggacaataattcttactaccaacactggttctgaccagtgaaattcaaaatcagtgaaacactactcagagtctgagtgagccaaaaatagtttcactttaggaaaaagtctatatccttagatgtgagtgattctctgtgaacattttattcactttaatatatttaaagaaaatctttctgaattggtgtgttttctttagtttgtattctgatactttgatgctaaaagcttttgactttaagttttcatggaggggctatctacataataatttttatacatcattatatgcatcaatgattaaaaaggagtagaaatttttacactaattgagaaatattatagacctaactaaatgcgggcaaactataagcaatttggggaaactataaggatgtaattaaatagtcactgtttttagaaaccattaactgcatattgaaatcttgacacttgttgggaaaatgaggtggtaaatcaacttgtcagcgtgagtactaaataaaacaaaatatggttaagagtgtccctttaaagttcagatagtagttctgcaatttctgattttaaatgtttctgcaaaatagtttatctgaatgattaaactattattccgtgttcaccaaccattaagaaaatctgctgtatgaccaggttaaacctgaaaatggtataattcaaaacttgatgtaggcaataggtatgtagaatgtgtttattctaatatgagagggcatatcaaagtaattttcttggagcacactgtcaaaacaaagcaatgggatttggccatggacatttcattattatcaaagagacctggacactaccttagagtaataactttattatttagcaaagatgttttataaaaagaacaacaaaatgagaggaatagaaatcacacaggtaaaacagataatctgactttgtgggtctcagagcagagattagtgtctttcagtttcagagtaaatgacctcactgcatttctctgaactgtcatggttgtcacaaatatactgtgttctaactcactccatgatttaaggtctacaaagtaacaaaggcaaaataacctatatgctctaccatattttcctcaattctagtgttcttcaaagagagaatgttttctctaaatctaattgagagtaattctgtatggatcgctaaacctttcttcaggcagttggagtaatatgtgtctagggctaactcagaggggtcttttatgtcttttaaaagaagctaactatactcttgtgatatgataatcaccgtcattgacttacagtttctaaggtttgaagggatattgaacactcaaggggctcacattcttactgattcatgaatctcttcaggtccagggaacttagtatttttcaagagtgcaaaatgcctagagacagctgggaacaaatgaatgtcattcctgatactgtgctcatagttacttgagcttcatctcagaaaacaaattgtctggtgcaatatttcttacaacttagttcctaaatgaactcaacaaactagttcttttgttttattttatttattactattatactttaagttttagggtacatgtgcacaacgtgcaggtttgttacatatgtatacatgtgccatgttggtgtgctgcacccattaactcgtcatttaccattaggtatatctcctaatgttatccctccccactccccccaccccacaaccgtccctggtgtgtgatgttccccttcctgtgtccatgtgttattgttcaattcccacctataagtgagaacatgcagtgtttggttttttgtccttgtgatagtttgctaagaatgatggtttccagcttcatccatgtccctacaaaggacatgaactcatcattttttatggctgcatagtattccatggtgtatatgtgccacattttcttaatccactctatcattgttggacatttgggttggttccaagtctttgctattgtgaatagtgccacaataaacatacgtgtgtatgtgtctttatagcagcatgatttataatcctttgggtatatacccagtaatgggatggctgggtcaaatggtatttctagttctagatccctgaggaattgccacactgacttccacaatggttgagctagtttacagtcccaccaacagtgtaaaagtgttcctatttctccacatcctctccagcacctgttgtttcctgactttttaacgatcatcattctaactggtgtgagatggtatctcattgtggttttgatttgcatttctctgatggccagtggtgatgagcattttttcatgggttttttggctgcataaatgtcttcttttgagaagtgtctgttcatatccttcacccactttttgatggggttgtttgtttttttcttgtcactttgtttgagttctttgtagattctggatattagccctttgtcagatgagtaggttgtgaaaattttctcccattctataggttgcctgttcattctgatggtagtttcttttgctgttcagaagctctttagtttaattagatcccatttctcaattttgtcttttgttgccattgcttttggtgttttagacatgaagtccttgcccatgcctatgtcctgaatggtattgcctaggttttcttctagggtttttatggttttaggtctaacatgtaagtctttaatccatcttgaattaatttttgtataaggtgtaaggaagggatccagtttcagctttctacatatggctagccagttttcccagcaccatttattaaatagggaatcctttccccattgcttgtttttgtcagctttgtcaaagatcagatggttgtagatatgtggcattttttctgagggctctcttctgttccattgatctatatgtctgttttggtaccagtaccatgctgttttggttactgtagccttgtagtatagtttgaagtcaggtagcgtgatgcctccggctttgttcttttggcttaggatcgacttggtgatgcgggctcttttttggttccatatgaactttaaagtggttttttccatttctgtgaggaaagtcattggtatcttgatggggatggcattgaatctataaattaccttgggcagtatggccattttcacgatattgattcttcctacccatgagcatggaatgttcttccatttgtttgtatactcttttatttcattgagcaatggtttgtagttctccttgaagaggtccttcacctcccttgtatgttggattcctatgtattttattctctttgaagcaattttgaatgggagttccctcatgatttggctctctgtttgtctgttattggtgtataagaatgcttgtgatttttgtacgttgattttgtatcctgagactttgctgaagttgcttatcagcttaaggagattttgggctgagacaatggggttttctagatgtacaattatgtcacctgcaaacagggacaatttgacttcctcttttcctgattgaataccctttattcccttctcctgcctgattgccctggccagaacttccaacactatgttgaatatgagtggtgagagagggcatcccagtcttgtgccagttttcacagggaatgcttccagtttttgtccattcagtatgatatttgctgtgggtttgtcatagatacctcttattattatgagatatgtcccatcaatacctaatttattgagagtttttagcatgaagtgttgttgaattttgtcaaaggccttttctgcatctattgagataatcatgtggtttttgtctttggatctgtttatgtgctggattatgtttattgattttatgcaagaataatctaaatttctctggtgaaagaacctaaacatgccttttaaaaatttatatatcattccttttgtaaaatctaatgaaaataacaattttgtctattgtaaaaggcaagtgattgcaacagatggaaatcactttatttcctatatctttgtaaagataatgactgctaataaacaacatgaagaattttcaggtataattttgataaaaatttaatggttttgggcttctaggccaaatctgcaatacaacccttcataagattgtactttgaaactctcgttgtcatctgacatatgcagatagtacagaaatataatcccctttctaaatgtttacattgtctccctggtatgaattagcttgctggaaacatcagtaatcactgacataaagatcccactattaaataaaactgatactttttaaaaccatgcagcaaataagaaacatttcataaagcaacacaggattttatatgtttcccattccattagaggctattatgctgaattggatcctcattccaacctgtgtccatattttagggttgaaatagtctaaaacataacatttactgttctcctgttgtgatatctgtatagctaatatgttcacattctctgtattcatctatgttaataattttaaaaaggaaaagaaagggggctttaggaagaactttacatcacacgtcagagtaaacatcaaatcaagttctcaattcactaataaacccatttaagaaaaagtattccgctagagagcaatgaatcttattgtctttgtgtctgatccatatttctccacctgacacatggaaataaccagagagttactataaaatacctcaggtgcattgttgaaagtaatttcctgcttttgtgggataactgaaacataaacgtaaataagatagtttgaaagttcactttctcatcaatgctcaaataatttgttctaataaagcccagtaaaatttagcttgtaatgccatcaaggtaaatatattcatgaagtactcacttgctaaatttttaaacacaacacattatctcatctttaagctttagctgttatttcaattatccattgctgtgtaattagcagtcatcaaacttagttgcttaaaacacaaactcacaatttgttaactttggttgggctcaggaggataatagtcggagtcttgcctaggtttccttatatgactgacaaggcctacatagtccaaagtgacatcactcaaatatctggcacttcactggtgctatcagctgggttctcctccacttagtctctctggtagagtagatcaggttctcatttggcattgctgccattttaatttggcaagcctaaatttactataatttgtcaagtgtctattaagtcagtgtcagagagggctatataaggatatggctatgaggagacttaataaatcgagggttctttgatataacaggctacccagttacatttcttgttctaaagattttttcagatacaacaaacaatattttacaatttaactggtagatgaatgagtttcctgagatataatttaactaagcaaactctttcatactaaaaatcttatgacctctttacccatcttaggttttaagattgatatgagaggtattctggaatagaaatctaaatttaaggctagagtcaagagtgccgaagataagactcttatccaaaggaaaatcaagcaactgctatgtcttgcaaaggccagtgagcagacagaggggagagaatacaattgcaccaaataaagactcactttggaactcagtgattatatgtgtgcatatatgtgtatatatatgtatattatacatgtgtatgcatgtatatatgtatattatacatgtgtatgcatgtatatatgtatattatacatgtgtatgcatgtatatatgtatattatacacatatatgcatgtatatatatgaatatatataaaactgaaaactgcacacatcccatatacaccatatacatgaaagtgaacacacacacatacataaacatatatattcagtttcaaacaattgttagggaacctgaggaagaaactaaatggaatataatggttgcatctatgatagccatggtactagaactagtagtagttctactaaggtgagaattgacatagtaaaagaaataagatacaaagcagtaagagagagctacattttccttaaggccaggctgaatattcactaacaaggaaatttctacagtcattattttaatctgattcattctcttggtgggatattccagagttaccacctacagaaattccacttttccttaccgaggttctctttttttcttctcagtccaaatattagtcattttggtagagaaggcagaaacaattaacaattgagtaattcctcaggaatcatgttaaaaggtttccaaatcatgaatgtatagttatattttgttcactagattttaacccacatacctcacttgtagagaaattatgcttatttggatattcaatatatttcttcatacaaagacaaaatctataaaatgtacacacacacagatgctatggatacatgcacacatgtgcacacacaaatatgtatacatggtttaccattattttctagatcattcagaggtcagtattaattaaaacatcatagatctatggcaaattttgggccacttttcctaagacaggaatttaaaaagccttcaattgtcataacaatgggaagaagtctgagagctggagtaagggaagttggtgctcagaaatattaactaccatttatataggatatccttatgagataatcttaaagccaaatgaggctaaaatattaatacgagttatttagccaagttttccagcaggaagaaggaaataagcagtgaactaaaaagcatacaagatacagaggagcaggttaaatgaagccattacagcagaaattgagaagaataaacaggagttagaagatgagagcaagcaattgcaagtggagtgggctgagctggaattatggtgtagaaaatgactggttgagaaaaacccaaacaaatatttctataatgtcatgtgcataagatacctgtagatgttatcaaggtatatacataaactacctgtcattagagctaatttcttagcaaattattcataaaagtttataactttgtgaggcattacagacaccaaaactaatgatttggcatttccgtggcccaatttgtctaaagaactatcttttacactttactgttttttaataggcaatacagtgctcaaaaagtcttttataccaagtccagtaggttgataacattgagtataactgagtattgctttgtgtctaccctcaggcaaatctggagattttctcaagcctctttatgaaaatggagagacctcacaagagatgctaatggacagctgaccctgctccctgctccatcacaggttgtagagtattaattcccaagttacccagacatttagttctgaatgtgcaaaaatggtttaggttcaaatgttttcaactactgacaagctcaagaattcagaggaggtagtactaagggaaatgtaattaatatataatatcaaaacttaagcatagcaccataacacctaatttttgatgatgtcaaatacttaaagttctccctttttattttctggtgaaaggtgcgtagtatacaaacctctactaacttcttgggcttctgaataaaggaaaggactacctaatgactgtaatagcttgactgctgaagaattatgtcaattaataaaaattgcttcataggaaaaagatgaattgtctcttcaaagtttttttaagcatgggtgaccaaagccatcccatacttagaagaaaatattgcattgttttatacaagatatgctgtacacgttacagaagattcatgtttaataatgcatcttgtaaaaatcttagagagctataaccttacaacataacttaacccaaatacattgaaaaccccttggatttagacctacagggaggtggtttttctttctgtaccatagcacgcatagttgaagcaaacatactccttcaaacataatactcttacataatagaaagtgttctctgttttctggatgaaaaggcatgaggtcttttgtattagcaaactgaaattgttaactataaaaagtcaaaaatcaaaggtgctctcacttatttataaggaccttgaatggctgagattcatcaggaaaaaaaaacattcctcagagagtctgatctcaagctgatgtttctttattgaatttgattctaaaccatcatttttgttgaaacctctgtgctttcagaatgctgaaatgtaaaatatttttaacttatgaaagagataatttatttttattttctcctatacatttttaagtagcaccttaaaaaatagacaaatccatccagggtcaaaagaactcaactcaattctctatcactgtgaaaatagacttagttcttcattacaaaagcactacaataactacaaaaattatacctcctggagtatatatttacatatccatgcaaaaggggaatagattaaaagatgtttatgaatgtctaaaaccttaagtcagtttaacgtagtattataaatcaggtttgtgggtgatattttgtctgcttctagacttgtgagcaagttattaagttttaggttacttatatttaaaattcaaaaaggaaatgattgtgattgcattcaaagaaagagaggacattttgaagcttcttttttttactaatatcaaaacataatatcacatttgtaaaacacgttgatggcttacaaccaagtaaaatacctcaataccccacttttcaagatcagtaatattggcctaagagtatcactctataggaattataaaaagttgtatttatgccctgagattataccctataatgtgcaaatattataggatagacaagtggatataaggtttctttctaggtttccttatatactccaaatggtaaaactagatggaagattaaaattctaaatgttgttaattttagaaccttcaatgtcagagttactttgtatgaatgagtttagctaattttccacactatgcatatctaatagaaattactattgcacaggtgagaaaactgcatctctgattattattattcactctagtcacagagataagaaagggcaaaatatcataatagaagcccaaataggtcttattttaatggaatatttttccactggacttcaactggtttatcttatttatccatccatctaagatcagttgaaaaaagagacttgcagatgcaatattttagctaatatatccaatctcctatttgaaatctcctgcgtatctaacagaaaactcaaatttagtatgtctgaaatcaagctgactgctgcacgtgttcacactgaaacaaagcaaaacaaaattccttcaacagcttttctcatctcaataaatggtactacactgtgcctgtatgactcatgcccaaaacctagaggtcgacctaggttctttttttccccatgactctccatttccaagatttccgtttcttccgtgaacacttctcaaagccacacccatctctctgtcagaataccacaatgcattgcaaatctgcctccccacttgtcatctcctccctaaatgctctattttcacagtagtcagagtggcttttttttttaaagcacacaagatcttgactcttcattccctactttctgctttaactccttgtttggctttcctctgctaatataaagaaaaatttccaacttctttttaatgaccatagatcctggcttgatgttttctacctacctctccaaccacgtcatacacttcccttcttttcttatcacacccaaaacattcttaattatttccacagtctttgtatatgccaaccctttttctgcctctagaattttgtgcttgtttctctttctttctaaaataagctttcttggctttttgtaaaattagatcattgttctttgaaatctcggctaagaagttttctgaaataccttaattaaagttccttccctggttactagcagtctcctcacttcgtttatttttattgtaatctttaatgattgctttctatttgtttgacttcttgatcaactcaaatttgtatcctcagctcttatcaaaatactaggtaactacacacttattaaaacaactaaacataaaaatagtgacaacaaaagctggcaatgatgaagaaactgtatcattcatacattatttgaattgtaaaatgttataatactctggaaataatttatcagtttctttaaaaactaaacatatatttataataagatccagcaattgcacccctggaaatttatctaagagaaatgtaaacctatatgcgatctttaatatctttcatagcacctttaattctaacagagaaaaactggaaacatccaagatgttggacaggtgaatggttgaataaactgtggtatatccatatgattaaatactacccagaaataaaaaagaatatacttttgacacatgcaataacttgcatagatctgaagggcattatgcttagtgaaaaaaagcaaatatcaaaaggacacatggcatattatttcatgtatataactttaataaaataacatacatatagaaaacagattagtgatttccagaggttagtgatggtatgggaatgtgagatgaatatggctataaaatgtgaggaagacacttttagtgatggaagagttctgtaacttaattgtaataatggtcacattaatcaatacgtgataaaattggcatagacctatgaattcacattgtataaatgtcaatgcctggtcctgatattgtactaaattatacaagatgtaactcttgaaataaactgtgtagaatagtacacgagacctctctgtatttgaaactccctatggatctaagatcttttcaaaataaaaagctaaaaaatgctaagtgttcaataaataaaatagtaactgtattttatccaattcttaccatataaaaatgcttcacatacattaactcatacaattcagtctatagcaagatcatattgatgccattattagtcctaatttatggcctagtagcttgttcaaggtcacatagctaataggaggaagggttatgattttaatccaagcaaccagctccagagaatgtgctaccaactgacacatcacagcgtttctcaaaaataattctggatggaaggaaagaagggagttaaggaaggagagagagaaggaaggaaggaaggaaggaagggagggagggagggagggaggaaggaaagaaagaaggaaagaaggaaggctggaagggagggagggagggaggaaacagggaaagaaggagggaaggaaggaagatacaataaaggaaggaaggaaggaaggaagaaagatacaatagccagtatatttactcaaagagaagacatcataaaacccttttaacaaacacagcctgacgtctcaaattccttctccattcaacttccttgactgtagagtcctattcagggtcaagggaaggagaaatcaaactaaagatcataacgctgcatgtatgtggcattgtattgccagagttctctgagtaaacctttctagagatgcacattttgcactctattggaaaagttatcttagttataatgtttctgaagatgcatttgccatattgaaagcaagcagtcacatacaatttgatagacaccagcacaaatgacaataaaaacttggtaaagttgaagagactgcctttgttatatctaatattctatcaccccagatctatcttctcaaatctccacattacttagcctaaccctatttttctattttctagaggagcccaccacattgatcaggttgatttattcacattttcccaaaaatgctaggtagattccttcctaaatccattagtaagttatagtctgtattccccatggatgaactgtgttcaccagttatgactcttaggaggaacttcatagaagatcttcagtggcatctattggtacatgttggacattaactaaaaatgtatagttttagcaaccaacagattctattcttatacctgttggtcatgtccaggcagttatgtgtaaaataattacacaatgtttcaaaatttcaagatgtttgcctacctatatagtgtccttcactctcctctccagctttccaaataatatccataattcaaagaccagttaaatcctacaggcatattcacagaataactgccctgaaaacattgcttaaattaatgagaccatctatgggcaatgcatcttcaagagctcaagatctggtgaaaaaatggaaacaaagatgaaatttcaatacaatgtgatgaaaattttaaattatttctctcttgcaaatttccattgcttgtttgaacattcaggagaatagtactgctttcccattgaatgtataaataaatgtaagaatgaaggttggccctccctccaaattcattaaacattaaattttttaagtaaaagataagagggctgtatgaaaattaaaattcataattacttccaatatagaaaataattgaaatagataaaaacacaaccaaatagaaatggatattgctaaaaatcaccttcttaattaaattagtaacaaaagtgaaattattgttctatccatattggtgacattgcttcttaaattattcaaattaaaatatattctactggtgagttcaggaaaaattgacaataaacaaatagtatcatacacaaagaaatataactcactgttttagcctagcaactagtgtttacagaacaagttacagattattctgcaataagaaacaatcctaaagtgtttttaaccttaaatcaaaattcaaattagaattagaaatgaaatgatgttctcatttcagcaatgaatacagaagtgaaatcacttgatttttctgaagactgtatttttcagtgttcatctggatttaacactttaaagaataccttttattccttaaataacattcagtttgtgaaagtaagcacacctttttcagctccgcttattctgcagaaggatccttccatatcaaggattaacacaatatgcatcgtgggttcacaaagttcagtttgcagctatccttagcaaatcatgagaaccatctggactgattgatgtggagattgaaagtaattgatcctgccattgagaaactttttgaaacatgaaattaaacaagatgatattaagcattctgaagtccatcagagtggcacatcaaatgtgttactagctgttcattttcctttgtatttttataaagacccttggctagcagaatggaacagaaatagaagctaaaagatctagatattgatgtagtgatcaaaggcatacagctggtttactttgttataataatattttatgtggtacatgaagactttgatcccttgacaaatgtcctttgtaggtgagcaattattaataggattgtaagtcttaatatgcaaggatcaccattaataaaagtagactattgtaaagtgaattagcaataattttacttatgaataaaaacttatactatttcaggtcattttcttattgtttcttgaaaaaagaagtcctttataagtccagttaaatattacctaatttttgcataaaatttcatggtaaacaaggcttattttcttactttactgatgtctaaaagctaaatttcactggtgatatatcatttgtttaagactaggtaactgataacctaagctgagacccaaaatttgttattttctttatttccagcacaatattttccatcatggtaaaagaagctatgtttctttagcaagacaattgaaaagcataaacaatggtttactagaaagatttttaatattccatattatttacaactgtttgcttatttccatgtataaaatgacattgattcaatagactttttccacatttgcatgatattcagctataacattaactcaggcaatattcatatggctccagaattaaaccggtatctgacctcccaattgaattagacgataggcattttgtgatttgaggaagacatcctatgaatttacaaatgtccagaaagttatacaaaagaaaaacaaaagactttagtctagttaaaagtagtgctactatttcttgaaattctgaaagctgtaataagtatcactcccaaatctggggataaagtacagaaaatggcagctcccaatataatcttggacatatttgtcattaagaagcacaatgaaatatgacaaattgtacagcaacttttaaaaattgctaataactctttgtttatctcagtagtaaaatttaaatactgatccaacctgacacatatgaacataacatacctattctgaaagacaaagaatatgtatcaatatttatattatatttaatacaaatcatggaatatagaattatagaattgtgcctacttacctagaaaatattaccccaattttgtttttctaagcttcaagagagatttcttggagaaaatgagattttataagcaatgctagcaaaaaaagacaacttaaaagattatggagaaaaaggcgtattttagatacaaaacacagattgagaaacacttaggggcaagaagtaatgcatcactggccaatgtaaatgaaccgtttaggcagtaaaatgtgtccaagcaagtggtgagtatatcctgttctcttttatatatctagacaagtgatttcaaacacccacgtggagccctgagaccctgggtgttcacctaatgtaagccccaatataggagctgaggtcaactaattgagggaatatgtccaacaatcaataagcaaattagaatgagctaactgtcacacattcttaccctcatccctttgctgcattaactgagcaaacagctctctctaactatgtaggaaaagtgttagtactcaaataaaaaggtaaatttaataatctgcttaaggctgtatgaaaaaatgaagcaatgtgtatcaggtttcttcaaatatatgcatattgcaatccacccttatttaccctcgattgtaagagctaaaagcaggccgggcacggtggctcatgcctataatcccagcactttgggaggctgaggtgggcggatcacgaggtcaggagatcaagaccatcctggctaacatggtgaaccccgtctctattaaaaatacaaaaaaattagttgggtgtggcggcgggcgcctgtagtcccagctactcaggaggctgaggcaggagagtggcgtgaacccgggaggcagaggttgcagtgagccgagatcacaccactgtactccagcctgggcgacagaacgagactctgtctcaagaaaaaaaaaaaaaaaaaaaaaaggaaacattttgcaaatgttgaatttaaatgcatatttctgctttcatatagcttatatgataataaagctatatgcaccagcagatatattaagttttatattatataacatattatatatattttacactagataatggaaaaatggtacctattatgttggtgaccacaattttggcagccttagaaaaacttcagggccgggcacggtggctcacacctgtaatcccagtactttgggaggccgaggcgagcgggtcacgaggtcaggagatcgagaccatcctggcaaacacggtgaaaccccctctctactaaaaatacagaaaattagccaggtgtagtggcgggcgcctgtagtcccagctactcgggaggccgaggcaggagaatggcgtgaatctgggaggcagagcttgcagtgagccgagattgcgccactgcaatccagcctgggcgacagagcgagactctgtctcaaaaaaacaaaaaacaaaaaacaaaacaaaaaaaaacttcagagcataagccaaaacaattagaaatagcatggctttaaattaatttttcaagaatcttaaggtgacaaatattctgtcatctgtcatgcaaatctagttccacagaagggcaaattaggaatccattacctggaaaaaccattcctcatgcctagaagaagaatctctacaagtaggattcttgctttcaacatgcccttataaattggagtcagactgaatcattttttcttggcaatggacaagaaaatcagactgtaactgtagctttgtcactgagaattggtcaaccatttcaaaataggttaagttttctccctctgatgtttctactggggcttgaaggattgataaatatgcttctattctctgtcagaattttgaactaagggagagataccaaagattcaggcagatggagatcaagatggcaggtttatttttaaaggagctatggggaatctttgtggtgacaatagatttttctgttactgtagacacacataccttcccagccacaagtggtgctagacaactgcacacctctccatcccacctcccatcccaacagatacataggcattttcttcagatgttgatgaaaataattattttatcactatatccagataattccaacaagcaatatgcttgttgaggtgaaataatttttctaagatacaaacagaaaatatatacgattgaaatagacactaggtgatatttcacatatgcaatatgagctctgtttctttgacaagacagatgaatgaagaattcatgtttgaatgattggcattagtctaaagtattaaataatgaaagtgtccatattctctgcccagtatgatcttttaaaatatcatccacacaaatacaagtgaggtcatattttttacaatgaggcatcaaatttaaaggcagcaaaaaagtaatgaatatacctcttaggctaattgtttaccttagtggctttaatgatatggaaagttgaagtttagagtgagaaaagcaccaaaaaagaaactaatcagtctcctgactttcatatctggtagtcttagaatgaatgtcagaactgtcacaggtcaaataatggcccagtatgttttcaaataagtgacactgaacaccatgttttagaagtacatgattgtccttcttgatgttaatctcacaacttaaggacatgcttgccaaacatcataatttcttttaataactcatgtcagataaatctccagtggagacctatgctctggactccagacttatgccaagtagcctaattactatctccacttgcaggcaaaataggcatctcaaagcgaacatacctcaaaaagagctcttaatctcctactattctccccacttacccagcatcttccccattctcaccttctctcatcatgttcctcatatcaggaggtaatagactccatccttatagttatacagttattaagccacgaaacaccctgtttatacccttggcagccctatttttttctttaattatactttaagttttgtgatacaggtgcagaacatgcaggtttgttacataggtatacatgtgccatggtggtttgctgcacctatcaacctgtcatctacattaggtatttctgctaatgctatccctcccttaccccccaccccctgacaggcccttgtgtgtaatattcccctccctgtatccatgtgttcttattgttcaactcccacttatgagtgagaatatgcagtgtttggttttctgttcctgtgttagtttgctgagactgtggtttccagcttcacctatgtccctgcaaaggacatgaacacattcttttttatggctgcataatattccatggtatatatgtgccacattttctttatccaggctgctatcattgatgggcatttgggttggttccaagtctttgctattgtgaatagtgctgcagtaaacatacatgtgcttgtgccaaccccatcaaaaagtgggcaaaggatgtgaacagacacttctcaaaagaagaaatttatgcggccaacaaacatgaaaaaaagctcatcatcactgtgccgggtccatcccgcagaccctggctgagcaacagaagaaaggagtactcagacacaaatatacagggtaagagcaggctaggaggctgcgagccctaggggcagaggagagttagcagtctcgataagccagagctgcttgtatttattcagtactggtataacgtccaaggcctggagtcaacacaattgctgggtaattaacatttttgctccctcttacagggagcagtctcatgctcagaagttcaaaagtcagtttcctgatgacataagtaaacaagcatatttagataaacttcttcacttttccttgcacctacttctcacccttagcctcagagaaagagaattttcttccttcacctttattctctcatgaagcttttgcaagaccttccaacctttcaagaaggcttgcgtctttccttatagcttctcccaccaccctgaccgatctcccacatcactggtcattagagaaatgcaaatcaaaaccacagtgagataccatcccaagccagttagaatggcgaccactaaaaagtcaggaaacaatagacactggagaggatatggagaaataggaatgcttttacactgttgatgggagtgtaagttagttcaactgttgtgaaaggcaatgtggtgatttctcaagattctagaaccagaaataccatttgacccagcaatcccattactaggtttctacccaaagtattataaatcattctacgttttttttgacatggagtttcactcttgtcatccaggttggagtgcaatggcatgatcttggctcactgcaaccaccacctcctgggttcaagtgattcccttgcctcagcttcctgaggagctgggattacaggcacccgccaacatgcccggctaatgtttgtatttttagtagagacagggtttcaccatgttggccaggctggtctcaaactcctgacctcaggtagtccacccatctcagcctccctaagtgctgtgattacaggagtaagccaccattcccagccaccctcatttttttatagctcatactatgttaacaaattttatcaatagtaattcaaaacatcttcagattctgttcctgtctcaccaccatcactacccccctgattcaaaccaccatctctccactctccagttaggtttactgctatagccgcctaactggtcttcctacttccctgtagccccttgccttcagtctattcttgtttctgcaattagggtgattctttaagaataagtcagaccgagccattcttctcttaaaaccctccaatgacttcactctccatcccactcaaggtattagtttcctcaggctactgcaacaaattaccaccaactgagtaggttaaaagtacagaaatttattctctcacagttctggaggctaggagttgaaagtaaggtgtcatcagtctcagggtctctgaaggctccaggggaggatccttccttgtcttttcctagcttctcacagttgccatcaatccttggcattctctggcttgtagttacatgactccattctcttccttcatcttcccatactttatccactgtgtgtttttctaaatatccacgttcttacaagcacactagtcatttgataagggcccatctgaatccacttaacttgattgactaggcaagattttatttccaagtaatgtcatatttacaagtactgagagttgggatttgaacatctttttggggaagacacaattcaacccacattactcacatcccaaagctccttaccatgcacgcatctccagtcctttggtattcaaagtgtgatacacagaccagtagcaccagcatcccctgaaacttgtaagaaatataaactctccagaccacctgaatcagaatctttattttaatgtgaaaccttggtgatttatatgcaaattagaatttgagacacatacccctcaaaacgacctgcctacttttcttattatttcatctgctcctcactccatatcactctgtcattactctgcttgtgtcatattggcctttttgatattcctgtagtgcctggactattccttccccagatatttgcatgggttatttactcatctgcaccagatataaagatatagttattatatatagtgatatataattatacatatgttatcacacatatataaaacacagtgcagttgttcctggttaatctattttaaatatacatcctatcaaccccattcttcttccttgctttttctaattcaaaagtatttattttcacaaatttttatccacagctaaatattacagtgactattccaagcatttttctataaagaaaatctgtagtttacagatttgttcaaagtggaaaaatattttcatcagtagtctttcttccctggtgttaggttcacccctgaatatgttctgaactcttccggagaggcagtccttcatctaaatgtcagtgggtggcaaaatgttatattcaaatctggattattctgacacagtgtcacttcagaaagtagcttagtttcatttctggttgatcccctttgttagaattaggaatttaaaaaaaaaatcttttgtatgtaatgatctttataataataataaatcctgccctgtgtttgtcattggcattaacctctgtctacaccctctgattctctaattatggctccagtgggtacaaaaggtgaattatggttatttggctcatgcagcaaattaattggagaaactgatgacaaatagtctgtgaagaactacaaggtcttgccccatgctgtcccattttagttaccatttagttatgtaggcattacacaaatgcctcaaattaggacacctttgctgtctcagtaggtcgagtgtatgaaaatttactttatgcagaagaaataaattctaatttattggttaccagaatcttaatgtatgaaggttctaagtaaatatttgatgaattgatggtagcagcgttaatttttaaatgttccaagctcctagttttttcgttttgtttttacaaaagccttaaagtttggtactaaggaaatcaaagaatcaactaccaccatcatgcttcagggaaagggaaaaatgtctacctttgggtctaatctgcctcccaggcgagcctacaggtactagaactctaactgcaactatgatggcacagggaaaatgcatgtatgtaatatgcttgtcggcttcagcaacaactcatgtatacatacacatttactatatgtaaacaggtcccgtataatacttaaaacacaagtgtttgatctataaatatttgattcttagtatttaaaatgcttctaatgttttaaaagacaaaactccaccatgatatcacattgaacattaaaattattcccacagcaacacttttttcagagaaacaattgagaagtcagttatcttagtcaccactaaaggcacctggtgagaaaagcctgaactaaattttaaatattaaaaaattaaagagacatctagtgcagagttcaaacctttatgttgaattgtttaagagtcattactgatttcatgacgctgataagtgtttgagatgaaatgattttttaaaatgcagagaaaatgctaacagaatattatatagttcccctaaagatgcttcttctaacctccaagtattaaataagattgatctaaatgttaagtacatataaagtatatatttgctagtcatctataaattttaagtacaattccagtgatatacctgtatcttttggaagagaagaactaaacctgccgtttcttaggctaagtagacaattcataaggtccttccttccccatttattctgattgccaagcttttgttcagtaagctcttggcatctagtgattaaccagtgacagcagacagtagtgttccttgtgttccatatcgtatttgccatcctcaatgtcttccaggtgagttttgcagtgcaggactttcaggaagattttattcctgtaggacaaattaatgatagaaacacaaacaagagtaggaatggggaaggatttcagcccagaggaagcctcagctctaaagagcagtaataatgagaattcaatgagatggaaagaacacattcttctgatcctatggaacctcatgctttttatcacctacattataatttagtgccatttcccagtctctgctaaataccctgattacaccagtaaaaggaaaatccccatttgtctaagattatcttgatgcagtctattatctcctaaatgaaaatcctgtctttgtgaggacagggattgcccttttcttgttcatcactatacctctatgcctgatagagaccttggtacagagtaggttctcaataatcatttgaatgaaataaatcctatgtaccacatagcagcttctctggaaacatcaaaaatcaaagaacgaatgtcctgtgaatgccagacaatctgcttgattgtactacaatgcaaaaaacatcttctttgctctcctgcagcacgtaactaattacaatgcagaccagtttgttagaagaaatataacagaggtatagatagcaagcctttaaaccacaaagaaggaagtgattaattctgtttcacccaatggagaggtgataatacaggaaaaaacctgcccaaggattgaggccactgtgagcttgtgaagaggcagaggctggaggtgcacttgagatactgctttcaggatgcttgtgccaagaacatatgaaccttaatttctgttactgggcctgtgtctccaagttataaagttcatatgtaatgaccttcatgatatgcctcatttggaaggaactagttatcccaccccatagccaagattctcatcacaactatgtgaggaatattgtagacacaagaggtgtataaatagcataaccaacaggacctccagttctcaaccaaaggaaaatgggaaaatagaaaatatcctcctaacatcataacatttagagtcccttggtgtggaccaactgcctctcattgaacagtatcatgtactggactcattccataaactcagatagaaaaagaagtagtacaaatttaacaccaggttaatagtactttctcttttgctggacaatagactataattaaaatgcacttctttttaatctttttttctcagggattattcagtttactctttggatgcctctaggatctgaaggtaagagcaatgacagtttcatgtttctagaaaagcgtgaagtgcttctggcatgttgaagttacgatagcttctttttaacaatgcaggtacaggaagctttgctgaataagttttcattgtcgagatggtcttcaccacactcaaaggtaaaccttttctctgcagatacttttcgttttataacctcatgtattccactagcattctgaagtacagagtactaaattttttcttcaggattttgattaattaggctaaatatattgcatcctcaaacccatctccctcaacagctatatttggcatagatcattccattgtttttgcttctcaagtcattctgcctattaaacagagccatagagctgtcattgagatgctactccacatatttaaatagggtttaaaataatatatgatataaactgaaggttgaaatcaaatgttcaatgagaagcagtcttctggggggattcaaggcattagagaaaacaagttgaagaataataatggataaaattttctatagttcattgtggaacataactattgcccttggatatatctgactgcctttcacatgtcagaaaatactagaagcctaacaaacaataaaacttgtatttgacagttatttttctaatacagatgacaagattccagtattttaatgtgacctctgggagtgggactagagatgccggcagtgaccactagagggtggaaaatcaatccttctagggatgtaaacagctttggtcccacaaatttgctttgtgattttccctttttttctctcttctagtcaacatccctgggttcatccacacctgtgttttctatgagttctccaatatcaaggagatttaacagtttgtttggtaaaacaggtgagtagtggcctctatgttctccctgcttgcccagaacacatttggtcaaatggggagcctcaacacccctactctttcaccccaatcatggcatttacctaaaatgtcctcttttggggtagaggttaaatagaggaacttacattttcacaaatcaccaaaaagtgggtacagagggcagctgcctttgttgggaacttataataactcataaagaataagatttggagaatctagacaatgatttggagagctgtctgtcaaactatcatccatcaaaatgagaactgtaaattgctggccttgtcaaacacagagttcttctcaaattatgtcaaataagagtagataggtgatgtttcagggttacggggcagcaaagaatacagttagaaaatcttactacaggatctcactatttaggtttgttttccttttgtgttctttttataaagtgtgcttgtgttacacatggaagcacatagaagtgtgcatgcattacataagggatcaccctagttagctattctattagaaatattcacagttaaatttctaccttggagatttgaaatgaatggaattaataactttgggcaacagatctcagctattctagcaaattgaaacccctgtcccatgccaccatccctcccccacaggaaaataagccccaggatttcttctagctttttgaaactcaacagatctcacaaatgcagagttgagaaatgtatcaatgttccacattaaggcttttcatatacaagcaaattttgtgaatgcctataactgttaaaactccagaggacttgggttcttttctgcttcaatttgatgaattacccatgaaactgggggaccttcacttctgattatgaaagtcccaattgggcatgtttgggggccccataagtaccgtaactttggtttatgttgtcagcagcccctaagatccccccaggccatgacggaaactttgttagcggtggtggcggttcagcaatttgatggtagggtgggcacttcaacccttttcttgcccgacacacactctccacgcactccctgtgcacagtccccacctccccgcagacacaagcctgtgcagttgctcagaggctgccttccttgctgcactgattctcagcagttctgttgacgttcctgactcctgcttcttttctggtcctgccttttctctccctataattttctcttttctttccctttactctctttacaaacctccactttcagtagagcctccaggtgcctcccaagagcttctgtaagtcaccacaacccaagaggaccagggagattccctcatgcagatgttcccagaccatgcacgtgatggcatatggagggcttcccaccttgacatcttcccgtcctttgtagaaacctggctgctggtatgatgtgaagtagtgactgcttgttggctgccacacatgcatgagaacgacaactctgttagttctctggcatttctagctcttgggaagagggcaggtatgggttggtttccaggcatggccgagtttacctagtgcctagaccactgctcccctgggtcccttaggagatgttcacaccccaaagttcatgatggcttgtcttcaaggctgagttgctgctctgtttttcaggaacatataatgtttccaccccagaagcaaccagcttatccctggaaaactcatccagtgcttattcgttgctcaactaagaacaggataatccaacatacgtgacctcctggggacagtggatggatgtgcttttaaaaagagatccttgcaaagcaatggagaatgtgttcttggggcaggtttccaggagcagatgtcaaaaagactttcatagagaagaggctttcttttgtaaagacagactgaaaataattgttatgtttatgtttgttccctccccctcccccttgtgtgataccacatgtgtatagtatttaagtgaaactcaagccctcgaaggcccaacttctctgtctatgtaatatagaatttcaaagagacattttcacttcctacaaattgggcacaaagataagctttgattaaagtagtaagtaaaagacaacctaggaaatacttcagtgaattctaagaaggaaggaaggaagaaaggaaggaaagaagggagggaaacaggaagaaagggaaaaagaagaaaaagagaaagatgaaaataggaacaaatatagacaaacaacattaagggccacgttttaagatttccatgttaatgatctaatataatcactcagatagtgcaacattgagaatttttttttaatggctcaaaaatggaaactgaaagtaagtcatggggaatgaatactttgggcagtgtcttcctgatgtcttcttagctaagaggagaaaaaaaaggctgaaaaaatagggaggaaattccttcatcagaacgacttcaagtggataataatatttataagaaatgaatggaaggaaacatgattctcctgaggataactttgtatgttaaggtttgaactaagtgaatgtatctgcagaggaagtattataaagatacgtcattagatccaagtgctgattaaatttttatagtttatcagaaaagccttgtattttagttcgttccatattttgaaagcaaaaaatatatattttatatacctttcaattgccaaatttgatatatcgcactgaagacagaccctgtcatatatttaatggcttcaagcaggtacttctctgtgcattatagaatagattttaataatcttatagcattgtacattattattgctgttgtcactgttattgttactgtggataatggcccttggtgtgttgcatagctccctaggtattctctgtttccatctttactttcccagaccaatatacattaagaattttgcatggtctaacttgtgtttattccaaccacttggaaagctcctgaaaagaaattttacatttggctgttctgtgctcctaatgacacttgaccttgttgaacaaatggcagagactttcccaaggatttgattgtttgtgaattatctgcatgtgtgctttttttcgtgtgtatgtatttcattaaaaaatataaatacttatgaaaattgcatccatattagagttaaccatgtgctatggatacagcaaccctacattgcaaataaaagtctgatcccaaaaggagaataagacaaaaatagagatgtggggctacttaggatatgtgggctgtgtggcaacagaaatgggcccagccattaggaagatggggcaaaagaggctgagattcaacagccatttctttattgaggttcaaaggagttttcttttaatattttaaccctttaaaatatcttctttttatttttaattttaaattctacttaaattctacttctgcctctcttttcttcatggggaaggagaggtatgggacagaggtgggacagttgatgtaaatgaactctttatttctacatattcacaaatgacatagacatctacttccacatttgcctgagaattgtcacatcactgtcccaaatgaatggtgcattactgaaagtccctaaaggaaatcattgttatgctataaatgcatgccttgttcttcaggaatgatcaactttgggcagagcttgatactaagaagatggagacagaggttgggttgggggaaatcccttgaattagaattagaattagagaaagaaggcctttggctgatttggttcctggagttatatcaagaagaatcgagccaggcttggaacacaatgttagcagggctatcttgacatgatcaatcaaggaaagcacacagtatcaggagcaggatgtggttgtcatgttcaaaaattcagtgggacaagaaacgctgaacttccacccacttcagccaggatcccttggggaatcactgtgttcaaccctgtgaagggaactttcatcgtagcaggagcctgtgggagttacacaggatgtggatctggcccactgctccattcgttaactggggcatgttcccttatccccaacacacacaaatacacacatgcacacatgtgcacatgtgcacatacatgcatgtgtttcaccctttcaagccacatacatgcatgtgtttcaccctttcaagccacagcactgggtccaaattccagaaaagctatgaaagcaaataattggagaaacacttgctggttttctgcccactgcaatacaagttagcccagccactaccctttcccgggaaaatcctaaaatgaacagtagaattcaaaattgtagaacagcagttatgaagctgagaattttatgaatgcaggagcctcatttggccctgaggttgccatctctcaatcagtaatgattacaaggctattagtagcagattcctgagaatgaaggcacatggagttgtgcgatctactttgttcgtaaggtgcccagtgcttccctgtgttcctgacatctctcagtgtataaagtccattccctgagcctaaactttcttgcattaagagctttccattaagtcagtttcttgcaaagggctttgtcctaatgcgtcagagtctgtgaggttagaatattcacaaatgagaagctaatacagattataggaatattctctgggaatattctaagtccagactaacacatcatctcttgagtaagccagatgtctgctatcctcctcccccacttcttattgtttgcatggggaaatggttaaataaatgtctgtggggttttcaggtttttgctaaggccagaaattaagaaagactgtgggaagtcacggccttttgtggtttgtatagagaatttcaaagagatccatgttggaatgcttcagagaaaaaaaaagttacatggagctgagaaagattacagtaattagtaagtatagaaaggacgtgtgggtgagttattgaggtgaatggagcaggaagtcacaatcatttgaagaaaaaaagaaataggtggtcctagaaatgccaggtaggtggaatgcgtttattttgtgccatgtgatggtgaagtcaaataagccctcctcatccaaaagagaaaacccagtgacccaggccagtaaaagactgattttttaagtgtccaaaatgaaggtggaacttacagggaacttacctcttgatagcgtttttaaaagggcaaccggaatagcatctcatcatttcgagaggacagtagtttagctttaatattaggttctgttggtttctaaaattatcacttgggatttaaaatcacatcatgtataccagcacacaaatatgcttcctttccatactataacaatgaaatatctaatgagatctcgtgagctgtcttatcgggggacctgccccgataatcacataggttcttttctattttcctaagtgtcgactggcttgagaaataaaaggacagagtacaaaagagagaaattttaaagctgggcgtccagggggagatatcacacattggtaggatctgtgatgccccacaagccacaaaaaccagcaagtttttattagggattttcaaaaggggagggagtgtgcgaataggtgtgggtgacagacatcaagtacttaacagggtaatagaatatcacaaggcaagtggaggcagggcgagatcacaggaccacaggatggaggcgaaattaaaattgctaatgaagtttcgggcaccattgtcattgataacatcttatcaggaggcagcgttttgagatcaaccggtctgaccaaaatttattaggtgggaatttcctcttcctaataagcctgggagcgctatgggagactggagtttatttcacctctgcaatctcgaccataagagacaggtacgccccgggggggccagttcagagacctacccctaggtgcgcattctctttctcagggacgttccgtgctgagaaaaagaattcagcaatatttctcccatttgcttttgaaagaagagaaatatggctctgttctgcccggctcaccggcggtcagagtttaaggttctctctcttattccctgaacaattgctgttatcctcttcttttttcagggtgcccacgtttcgtattgctcagacacacatgctgtacaatttgtgtagttaacgcaattattacaaggtcctagaacgatatacatcctcctcaactgacaggattaagagattaaagtaaagacaggaataggaaattacaagggtattgattggggaagtgataagtgtccatgaaatctttacaatttatgtttagagattgcagtaaagacaggcataagaaattacaaaagtattaatttggggaactaataaatgtccataaaatcttcacaatccacgttcttctgccatggcttcagcccgtccctccatttggggtccctgacttcccgcaacactgtctctgtagtaattgtttgccttcttgcaatgtggtgctgctgcctctcaggcttccgcatgtcacccagaatgcagctctattctccaaacagcaaacgatcctttccatcttccaggtatgggggaggccggcagctcgcccctgagctcaactggctggcagggctgatggcttccctcacaccatccgcactcccaagccgtgtgcaaagatccagcacgttatagaaggtttaaacaagggtccttgaagtaaagttttcagaaccagttgtctggcgaacaaacagatgcctgttccaacatttgtgtgaggatggcttgaaattttcattgacagctgaaaatagagccctcatgtcctatagattaatataaaggatgtgagggctctatttatcctctagcacattctagacggaaaccaagtttcccactgttagtggacagaagaagaaaagaggggagatgggccaactcccgaagtccgctctatgccagacacaagttctgatctccaaatatcatctgtatgtgtctggggtgggcgtgggggccttggtcgtggtgtcctatgattcagacacaaccgtcctgtctattcttttttttttttttgagacggagtctcactctgtcccccaggctggagtgcagtggcgctatctcggctcactgcaagctccacctccagggttcacgccattctcctgcctcagcctccggagtagctgggactacaggcgcccgctaccacgcccggctaattttttttttttttttttttttttttttgtatttttagtagagacggggtttcaccgtgttagccaggatggtctcgatctcctgacctcatgatccacccgcttcggcctctcaaagtgctgggattattcttaaatgattttatacacacccattttcccccttttacctgtaaactttgaaatgaagttgaaaggccaccagtgtccatgacaggtccctctgcacacatggtggcatggttaggagatacatgagcctgttcccaccccagggtttttattctgtcatgcagagccaagtgaaggatgccggtgactattgaagcctaaacagaacaaacccaggagcccggggggaaaaatggctttattctcagtatgaaaggcaagaggacctgattgggcaagtggtgggcagattgctgtcacggcccacttccgatgacattaaacaacaaaacccaggaatgactttggaccctgcctttttcggattttgattggtgccatcctggttcttccatcctgccagccagccggcaccccagcagttgtgggaaaaggaatttgactttgattaactgagaaaaactgtgcatgcgttttctgttttttctggaactgtgagggttttcctatgccccaggggctccctcacagctgtcctatcccaagcattcccgacaggaatctccagctgggttggagtgacagctggcttccagcaccgcagctccgcaacccctgctggcgtctcccgaggctcgcgcgcccctggtgggcgtgagaagaggcgtccccgcggcggtccggcctcaggaagcccgtgggaggcagagtcagtcccgcggatgacgcgcccagtgggctacgttcaggaagtcatttgatcatatgggcagagcgaaggtcaaggcatagtggataacagaaaccagaaatgaaaaaaatctctttcactcccgcctcctaactttcatattatgatccttacaggggaaagggtagtcagaaagccacgtaggactgtggagggagggaaatcccagtcacgtcgtttcagtgtgtgaaaggcaaaggaaatttcgggcccccaatcactatgcaaaaaggaaaaaattaagatggaagctgagccatgcaagaaacagccttttccttctattgctaagcaaatagctaacagatgaaaggccagatatctccacagagagctacactaggttcaccttttatgtaaagtaccgatttactgagatgaatacatcactgactattttcctacctgctccttttctcctgcaatgcatggattatgccatgtgaccataccctccctctttcgcctccacttttcccctttaaatactgaaaccttcaaaatatctttgcagaaagacacagaccacaggctgtctctgtgattgtgtgttccattattccaggcatgttcttaaccttggtaaaataaacttctaagttgattgagacctgtctcaaagactggtttacaagtgtgcatagcacatctgcaggcaggcatacatttctgaggcatactcgctgagatagctccttcctttctctgtccccctcttactgactgaatctcatttatggcactaacagcaaagctgaaagccccagaaaagatctggttcacccattccagataggctgctggaaggtcgtttgaggaagaaaaatgggtgccttccatatttcatgttaacccaatactttttccatcaaggcagctgcaaaaggattaacataggtggtcctattccctttcctaattcatccattgaaagccactgctggcctggagtttcattttcaatccatcatgaatctgcagatgaatctgcagctatcccagggcaatctgacagtccagccagcagctgaggctggatggcaagttcctatcctctgagcacacattgctaacgtgtgatccgagaagacccaggagaagtcaacagggccaactgccggcagggttggtccttggtgtagagggacaagctgaactggccttaagtaatgaggcagacagcttcccagtttggggggatgtcacgcaccttggcctgttgctcctataccctcggaatagctctcacaccttcttcttcatgttggacattccttttacaaaaacagaaatctcaaagacagataaagttaagaaggttaatctcaggttaatctcaaggagagaaaaggtatgcaaatacacctctgggtgagaaacacagtaacttaaatttaccctcgaatgaaaatggctggtaactatataactatattaaccaacattttttgagccctttctgtgtacctgctgctgttctaagatttttatgcgtataatctcatttaaactctatagcaaaccaaaagtaactaaatattctttttctttgcatttttagaggaaaaaactaagcacagagaggtaaataacttgcccacagtcacacagctgaggaccagtagaatcaggatctaaatgcagtgtctgacctagaacatgggcatgtatccaccaccttatattgcttctctatgcaacctgatgccagttacttgcttaaaagtaggcttccgtagcaggaagagtttcaaatgcaaaaaatgagagggagaacaacagtgacagagaggttggaggagttaagccttctccaagcttcatctcactttataattctaccttggggcagcccaggacataatgaccaatgttctgggcaaacttcagagtgcgcctacttcctttttaagtctctggtgaaacatcaaagaattcctgctgtgctgctttattgaaagtagatctcaacttagttatctagtggaccccccagcttgagtcttcagtcaagtgagcttcttgtaaggtctcaatcaccagtgttgtttttatttttgtctcagatctatcaagaattctcggcgtgttggatggcatttagacatgtaggaaggcaatatggcttcccagaaatgaagcgtgattctgaggctatgtttaaacatatcaagtggagaattgggacatttgtcctaatacgtttagctaagtcatgattttccttctgatatgcagactgaaacagcagctgatttgctacttgaatgctttgcattctctgcttcattttgcatggacaggggtattgggctgttcttcagcattgattgacagccagtttggcaaatgtggtatggtggttaacagcattggttctagagccaaactgtgtgcttttcagttgtaggtccaccacttcttagtttgactgttggtaaaataactctttctgcctcaatttacactatgtgaaaggaaataataatggtacatgctccatgggttgttgtaaaattcttataaagcctacaaaatcatatctggcatgcaattattgctgaataaagttagcctttattattttgcatcttactgtgtgtgcataaaaactatagtagatatatatcatacacacatatatacatcatgcatcatgacttagccaaatttattagagcaaatgtttcaattctcctcctgatatatttaaacacagcctcagaattacacttcatttctgagaagtcatactttcttcctatgtgtctaaataatatccaacactcagaattcttgatagatcttgacagaactcagatttagatgccagttctattcagaatcaaactacatatgcctttcacattgtcacttttaattcatggttaagagcttttgagagtaacgtcaaaggtacgtgacatcctaaatcataactttatcaaggtttgagtttaaatcgtgctcattatgaagccagaatgggtgagtaattcacataacaagtgtgtgagcctggttaactaccccatgtctgcatttcaaatcagttttggtaatcttacatattacataattttatttaatcttcaaactaatttcattatttcttttctttacaaatgagccaattatgcactataacagtggtgttaattaaggctttctcagttacaggtaacagaaccacaatcaaattagtttaagcaaaagtgggcacttaccacgtaactgggaaagatagtagattggtacaccttcaggtacagctagattcaggtgcccaaacagtgttctcagagttctggctcttccttttgtgttgtttcctctctttgtgtatttatttcattccaaggtagatcttcaaggagaggaatttatgaggtccacagaccgatagattgagatttaaaaagaagactaacccttttcttctccaaatgttcaggtatatgtggcagtacagggtatcatgattggcttagtctgagccatgtgctggccccatagaaataattatatccattaggatcatgttttctgtgaatgccagacattcaaaataatagcgacttaaagtagaagtttatttctctaacacagataagcagcccaagactggtgtggcagcctggctcggtgcagtcctcagaaatccagatactttctatttttttaatctgcttttgccaaggtcaccacgtggccccatttggcagctctcactctggccattacatccccttatcagtcattaggatagaagaagggactacaggtgtgcaccaagactcctttaggaaaggttcccagaagctcacatgcaacattccttcttccattccactggcctgaatttgatcacactacctcactgtatcagtctgctttcacgctgctataaagaactacctgagactgggtaatttataaaggaaagaggtttaattgactagcaattctgcaaggctggggaagcctcaggaaacttacaatcatagtggaaagcaaagcggaagcaaggcacgtcttacatggtagcaagacttgaaaagtgagagaacaaggaggtgtgccacactttaaaaccatcagctttcatgagaactcactcactatcacaagaacagcatgggggaagccacccccatgatccaataacctctcaccagttccctccctccacacgtggggattacaattcaagatgagatttgggtggggacacagagacaaaccatatcacccatctacctgcaaaggaagcaggagaaggtaaactagactctgagtagccatttgaccagttggagtttggggattctattactgagaaaagaagaatggatgttggtgaccatttttgttgggggctgatatctgaacatctcctctgcctcctgctctcttctcatacctttcttatgaccccatttttctattctccttttattctcttgaccagataggatctttaaatgtttttaatgattttcattgagctggtgagccacacatgggtcaatttgtcctaaatttgtctaggccctgagggatgctgtgacccagatgaggcccatgtctcaatccattctgggattccaggactagtccttggtaaaattgtggaaggcaaagagagatgggtcttgtctttactctgatatcactgttagctgcaactcttacacacacacacacacacacacacacacacacacacacatcctgttaggctgccttacccatatcaaatctttcctatcatattttttcacatcagtactcattagaggtcactggcacctgactccattatctcccatcccccattcattagggttttcaagagtctgctaaatgacactcacagctacaggataactataaatcttttcaaacttttctttgcttagagacttttgaaaaacatacttatattaaaattggcataagaaagatgttttagccatatttataaacatatagaaatttgagtaggtgacaaatcatccataaacctgatatccctaataagggaaaccaagtaaaaaagacctttacatagtgttcaatatagatttgcctatattttatagcaccttccaaacctctaatcttattaaggttttctgtagtcaaacaagaataatagattctgctattaagtggctctgtgacctgcctaaggcacttagcctctccagaattgcctcagtttacccaaatacaagaggtggacttcagaatctctaaaaatttcatcaagccataaaacagatgatataattcatgagaaaggaggagctcaagaagggaaggtgtgagatcatctgtaatttgcttgtaaatgtctccatataggtattacactgtatacagcctgcagggggactataatccacaccctgggggaggttaaatagtatgcaaagtattctgaaaaggaatacacactccaatagcagttagttagtatttgaaagatcctaatcaaaagtctctactggagaaatatctgttgcaaaactttaagtatttctatagcaagctataccagagggtttgttattagtataaaggatgcttaaaataatttttgcattggttaaatacaattatcaagatagctataggtacaatactttggcaggcccagtgaactaacttttggggtagaacctttgactagaactctatttggtcctagttttcactcacttaatacaagttttcattggctcatccaactagagcagtgattcccaatcagtaatgattttgccccttgggggacatttgtcaatgtcttagagatttgggattgtcactactggggaagtgtgctatgagcataaagtaagtagaggccagggatgccactaaacatatcacaatgcagagaacagccctcacagaaaagaatatccagctcaaaatatcaccagggctgaggttcagaaaccctagggtagagagttgactgatcctggccttcagattatttgaatgcatgtgtgtagaatgaacctttaatccaagaggcttggtggtggagcacttaaaaggacagagcagagacttccctacacatacaaaacaggttggatggctatttgtgggtttgttggtttatcgggggaaccagactccaatatttcaatgcaagttctttctattttccctaagtgttggctggtctgagaaataaagagaaagagcacaaaggaggaattttacagctgggcctctgggggtaacatcacatattgggaggtccgttatgtcccctgagccacaaaaccagtaagtttttattaggattttaaaagcggagggggtgtacaaacaaagagaaggtcacaaagatcacatgcttcaaagggcaataaagatcacaaggcaaaggcaaaattagaattactgatgaggatctatgtcccactgtgcacatactgtcttaataaacatcttaacagaaaacagggttcgagagcagagaaccagtttgaccaaaatttaccaggctggaattttccaatcctagtaagcctgagggtactgcaggagaccagggaatatttcagtcctcatctcaaccacataagacagacacttccagagcggccatttatagacctccccccaggaatgcattccttccccaaggtattccttgctgggaaaagaattcagcaatatctctcctacttgcacatctgtttatatgctctctgcaagaagaaaaatacagttctattctgcctgaccctgcaggcagtcagaccttatggttatcttcccttgttccctgaaaatcgctgttattctgttctttttcaaggtgcactgatttcacattgttcaaacacacatgttttacaatctatttgtacaatagtggtcctgaggtgacatacattctcagcttatgaagataacgggattaagagagtaaagacagacataagaaattataagactattattagggaagtgataaatgtccatgaaatcttcacaatttatgttcagagactgcagtaaagacaggcataagaaattataaaagtagcaattttgggaactgatacatggccatgaaatcttcacaactgatgttcttctgccgcagctccagctggtccctccgttcagagtccctgacttcccacaacaatggttaacaaatatgaatgtgtagcagaatttagttcaaatcttgattcattttaacataatcagagagggggttagagttcccatccacttctaattatcagaggctccagatattactgaaagaacctgacatttgtgaatggccagattggctcagctcagttcacagaaggaaaggatgcagatggggatgtatcaaggatatggtgtgggaagcatgagacattttcaaaatttcaagccactatgacttattcccactatgtaagattaaagaagtcagacactcagattcagggaggatttcccacatttttcatgttgctcatctaaatcccaaattccatactgcctagagattatgaaatgcttaatttctacccactccccatcctacatgcccactttgccatcaccatcccaacacctcaaaagaataaagtatctgctagtcctcctggaatgattgagggtttgggctcaaagaaaagctgaataccatgtcagatttatggtgagccagatcattaatcaactgaggtgaccattaatcaccaaaagtgataaagatagatagtaggcatggtactggttgagaatctagagagaaataaatatcaaaatgctttaccctcattctggtacctccttatcattattttgacctagcagttttaatttgcagtactagatgaaaatactaggttatctttgaaatttgagcttctgcttcttccagagagaaactcatatatttaagaaatgttgtcattggtttgggctagggacctttccatgtgagacagaccacagcatgttccttttaataaaaccaaaggacaataacagcagcagcagcaacaaagcctagagttcacttctgaggtcagatactcagcagagtgttaagggcatagctttctttaggcctaactatgaggttagtggagggtttgcaggactgtgaagcacagcgagaaacaaagctggaatccatttccaatctggactttggagataatacaactgggctggtgacaggatagcttcctatctagtctgaacattgaatagtaatattttcatacatattaaactctaagataggttcatattcattatcccattgtattactctgctactctgtaagtagtaaagtcatgtggaaggagatagtcagctattatttccatttgacaagttagtaaactaagatcaagagcttaaatgatttcttactaaaattacccagccagctggatgggcaatccaagcctgcagccaggatgcttggcttccagacttgttttctatccactagagcagtggttctcaaggtgtctgtgaggtgggggttgtgggggagtcagtagcagtagcagcatggcctgagaacttattagattctggcacattcttataccttgttagatcctggcacatttaagaatgtacattcttagatctcaccctagatctactgacccagtttctacagaggacaggaagatgtcaaggtgggaagccctccacatgccatcacatgcatggtctgggaacatctgcatgagggaatctccctggtcctcttgggttgtggtgacttacggaagctcttgggagggacctggaggctctactgaaagtggaggtttgtaaagtgtggggccctgtaatctgttttaatcagtcctccctgggatacagatgcacctcaagtttgagaggtattgccctcaggggtgctgttttcacttgctacaaattgttctcatacctttgcattaaagaaactcttgttaatctctcattttgtttccagtgcattttaactctacaaaattgtcataaagtctctacttaggaaaccttataacttaaaggaccactcagaatccttaaaatatttttgtttgttaaatttcctgagctgactcattgctgattgggtatagaaactttagctttttttttttttttttttttttttcacttgatctatcttggaacttccttgccccagctagatttttatctccttaggaactatggaaagaaagcatatctaaaaatacttctttaaagttctctgataccttctgtttgttaatatgataatgttgtacataaatagctataaaatatactgttaaacttaaaagatctgggaaagagcttttgaacacccccaaccttcaacacacacatgcacacccacacgtacatacaataccagatacaaagaaggtgctaactcaatatttattaaatttattaaagggcttctcttagaatctcagaggaaagcaaatgctgtgaagccgggctgcctggaagtacctttatttgaaatctttaacaagatcttaaaagagtaatgacagtactgtgtctaatgaaaaatgagtatttgattctaacatattcaacataagaatttcataatatatatttgatctgcaatataaatgagagtttctatatcttattcattcatttattgttttattcattcaaccattgttgagtgcccacaatgtgccagccatgcatctaggcacgtggccagcatggtcaataacaacatgtgcctgccctcatggggcttacagtctataggaaagacagtcaatcaaacaagtggtttacaatgaagtatgatgaatgttgtcacaggacacactagatacattaggagcacatagcagagtaacagaattatgtggggcagaaagatgacaagggtcacacatggggctggaggccttagaccttggaggtcctatccaaagcaaggctgacaaaaaagctgccccaaactgcactgaccattggaaggtaaggcctgcatggaggaggtgctgctgtggtctggccaatgccaacaggcaggtcacttccttggcctttgggaaaggatggcaatgatggagaaggtcaagaagatcacaccagccgtgcctccaatcaccatgcccaggacgctgccgtgcaactgcatggcctgacagcgctcccatttagaagaaagcatgtccagagatgcacctgagggaaaaggacatgaagagagtgtgggaactcccaggcctcaggtgcctcctagcaacactcatctccacagcaataaaaatggcaaacgctcactgagcaggtccacgtggtgcctggtcccatttcaagtgctgtatatggaccaactaatttaacccttcaacaacttttgaggtggaggctattacttggccattctcatcatcttcatcttacaggaaggttaaataatttgctcaaggtcccattgttagtaagcatttcacacttgaaatctaatcccaagaggtatgcctccagatccaggcttctcagccacctaggattcaggaggatggtctgagacacttaaaggaatacattgcctgacactggctaagaatacaagctacaaaggaaattccccagatacagtctgacttagagcatcagtggtagcttgaaaacgtctaaataatattaaataaaatgttactgtaaggttagtgtgtactgtcactatctcacaaggttgccctgaagttcacctgagataatgaggacactgtacctatcaaggtatttgacacagagtaagcacataatggccagcccttagttttgtttcttaatgttatctggtataaagacgaattaatctcataaccaaggcatataacttgtagtgtctcatccatacctttgtaaaaattccagcctttgtttcaaacattcccactagaaggtctactcagcagaattctacaaggcagagtgaaacaatcagaagtcagcattttctggctgggcatggtggcacacgcctgtaatcccagcactttgggaggccaggtggatcacctgaggtcaggagtttgagaccagcctggccaaaatggcgaaaccagcctggccaacatggtctcatctgtattaaaaataacaacagcaacaacaacaaaaatagccagacatggtggcgggcacctgtaatcccagctactcgggaggctgaggcaggagaattgcttgaacccgggaggtcgaagttgcagtgagctgaaattgtgccactgcactccagcctgggtgacaagagcaaaactgtgtctcaaaaaaaaaaaaagaagaagaagtcagcattttcttttactaatcctgaatgattttaccttccaagtcctcatctctatcctgagaattgacttcttagaaatcagtgagtaatagcaagtttatttcattttttttctgacccagtcccctccaaacacaacttcgtaatatcccctactgttatcttagaaaaacttattctgccaactctcagctgcaggtttctaggagaggaatagtttggctgagtagaggctgacatacaagtggcaaccctggcctcccttagcctgggaaggatgaagcgtgttgggggcacacaatggaatctggcatctaaggacctgtcaggcaaagatatgaagacccatggctttggagcccagaaacagatgggccttccccagtaaaaggagccagagggcttcttggaagagtgattgattctatgggtggggcaggaaatataaaagatgagcctagagcatgctatggtgccagaaagtaacattgtgttcataaaatctgatgttgaaagatcacaggagccaacctggaagagctcccaaaggccaaagctgggacaatagaagcaacaaaataaattatgaaatcattgcaacagagcccactgaatcaatgtttatgattcctttgtgatatacataaacaatcgcataaacaaattaacggggtgaaggggccattcttctttacagaagaattctaattaatgaatgtgaaggacataggaaatcaacattagaagatcccagtggtgagtattgcagcaggttgtatcaatagatgctgaaattagcatgtgaggatttgaggaaaagcaggatgtctcaatggtcttgaactatctctcccaagatatgtatcaattacagagggagaaatggtaactcttcagtggagaggcctggtggacatgctgttggccagatgatgaaggttgacatcaccagtaatgacatgtatcagcatcatgtacctgctcacatgatgcaacaagaaggcacagcacatatttactaatcttgccacaaatgtgaaacctcaatttaatcatgagagaacaagatgaaccaaaaaaaaatccctaaccagtaatcttcaaaagtgtcaaggtaatgaaagacaagaaagaactgaggaattgtcccagattggaggggattaggagacaggagacataaaaactaaatgtaacgtgagatccggaattggatcctgaaatagaaaaagaacattagtgggaaaactgggaagagccgaataaggcctgtaatttatttactagcattctaccaatgttcatttcttggctatgctaattgtactatggtttgtgtaatatgccaacattacggaaagcagggtgaatggtatagagaaagcctctgtagtatttttgcaaggtatctgtaagtctaaaattattgcaaagcaaaagctacaaaaagaaaaaaaaggagactaaaaagaactcagaagaaatgtaaatttttgaggtaggcagaatagctcctacatctgctactgttcaaatggaactgttgcttctgtcatcacatacctccttttgtgaaacagtttttagggttttatgcaagcaaacattgtaaaaagaactattaaagttctttttaaatatttaaatttaaatatagcaaactgtactgctttttaatatttaaacattaaatatagcaaactgtgctgccagacagacctagatgcaagtcccagcttcagcattttccatctgggtacctttcagataaattacttaacctttctaagcctcaacttcttgatacaccaaatggggataaggagagcccttatgtcacaggtggcagtgagaatgaatttagatcatgcgtgtaagatgctcaggagaccacatgatgcataacaaggggtcagaaatatcaggtgttcttactactattattgaaaacataactttaacaatagtgcagtgtaaatgacagactgtataactaataatcattaggagctaataataacatctgcgtagtcagcaaagatttaagcttggtcttgagacccactgtcatggagtagaaagtccctaggctagaagccatcttggatgttgttagagttagaaattccaacaacatccaagatgctgttgacaataccccagaggaggaaaaggggtgaaagtcaagagacaaggagacctgggacgcctctgtcctggcagcgtaagcccatgaatccagggcacacctttgtagagtcaaggaaaactgcatccagctgaccatctgaggtagtcttcgccctactctgcaaacagcagcctttaccaggcataagcatgcacacggcccaggtctgctggcctgcctgtctccccagccacagagcctacctgcacctcgccacccacttcaggttcacacagatgccatcattttggcaagggtttgggtcacatgggtctctgaagtactgtggccagttatggtcctccagggggcctgtgttcttcactgacggcttctgtcagctgggctgcccctggctgaggctgacaggtacggcttcctctaacatggcctttcctgaaccttctttggagacctgctgctcctggccttggagaatgaggccttgggggctcagtcttttgcctttagtgggaacttcagtctggctgaggtgggtgatatcttcaggaaatagagggtcacgaggaagatccaggattagtaactgactacagcgaactcccacttctggtgaaagttccccagcctgcttctatctctagtgatatgtcacccccagtgacatggaaaagtggctttgaatccagctgattcccacggtactagctagttttattttaaagtaatccagtcacatttttatttattgaatttgcaaaatgaagcataaagttagcatggatagactgatggaaactaaattgaaatcagtgaactgttacctctgataaaattttcaaaaagatgacactaaaatttcagtttctttcagggacagttaaaataaagatgtgcgtccttgaccaactgaagaaaatgtggttctcctacaacacattttttttaacctcatccccaccctccatgtgtgctttaaaatcaggataaaatcagtagagtgccaagagcataggattatttactcaggaagaccaagaaaagtactttcaaagtccacaaacatgatgaggtcatcatttttcaggaaactcctccttttcagcatttggtgggagatgaaaccactccagccaaagtcaatgcttctaaaacaattacagtcagcatgataggttcccaccctggacggcctgtcccagatgacagtgtcatttgtccctgcaaaattgtaggtaacataaaatcacattacctctttagacttcgctttccagtttgtcttttatgaggatacagggctttgtgaatcagaaaaaaataaataaataaaaataaaaataaaaataaaaaaatgttggaaaaaaattaagctatttactctttccaggagaattgaaattcagaattgaaagatgggaaaggcagagaatcacagctctgagtgatcagttgtctgctactgcgtgatttttttaatgaaaagagagggacagctatggcttctttcttctgaggcttaggtcttctcttttgaaaaaaaaaaatagtgccaggtgtggtggctcatgtctgtaatcctagcactttggaaggctgaggcaagttgattgcctgagctcaggagttcaagaccagcctgggcaacagggtgaaaccccgtctctactcgggagtctgaaataggagaattgcttgaacctgggaggtggaggttgcagtgagccaagattgcgccattacattccagcctgggtgacagagcgagactccatctcaaaaaaaaaaaaaaaaagttttcccatttctttactgatgtaagtttatttcatgaacatagtgatattgagtgctattttaggagtaagtacattagctctgcacagagcctagcaagttccgagtatttgataaatgattagcagtatctgtttcctcaatcacaacgagctcaatgaggcagggatcacctgattcacttgtattgtaagtacctagcacagagtttggcacatggtaagccctcaacagatgtttgatgagtgaatttaggaaagggaaggaggatgtgatggcattgaaaatcttaacttgaaactccaacacgcctatgttatcggtattcccaggcggacaatgtgaggagaatgttactctttcttgcaccacagaatcacatctgtgggcctctctggttcgaggggcagttcttatttatgccgacaccacccacctggagatatgtgcaacttggaggtagtgaacaccaaacttgaggacatcctgttcctgacatcaggctcctggtcgaagatggtaattatcacctgtctgttttctaccggccactccaggatagcatcattctccccactgcacacgtgaaaagcaagtctcaaatagccagagctttctctgccatgggggtataaagttaacccaaaaccgcatccctctgaattgtagaatcgagggctctgaagcttgtccccttcgctggtgttctcaaggacctgggagaaattccggactgtccagacccctgtggggcagggggtttctgtcagagtgatgtcatccaggtaaattcccccagttgagttccgagggtcgccttttgtgccctggaaaagttagcgaaatttctgttcctctttgagtaccacatgggcaattttccaattatggtcatcatctcctgaggacagagaacaaggctggtgagaattgtggccaacacttaatgagtacttattatgagtgtggcacagtgccatgtgctttccataaatgatctcattaaatccccacagcagccctataaaataggtactattatgaactggttaagtaacttttccaaagttacatatttaataaggaaaaatggttttttaaaatactatgatttattttaaaattcacattcaaatcttaaccatgaatttgttttccactatcactataagaatccaggttctgaatttcctcctgagttggctggttcaactgtaacccctaatgttagcaatgaaagcccattaggctgaatcgtataaaatagccattttgtaagccaaaagtcaaaaaataataactccatatggtcccacctgtcacttgttgccagagaggtataaggaatgctgaagagcagataataacctgtaggactgactggatcttccctacctgaaaccgactccctctccaacatctagacttttttctcttccttatattatctgaaagttcagcatgtagggcagtgaagtaagccaaagagagtactattgtctagaaattcacattctaataaagattaggtctacttgctttttctctgagcatgaactagaagtgggacttttgaattaagagctgaggaaagatggtgagaaggctgttctagagcatgggatcctgggttgaacagcagaagaagccaggcaggagcttgggggcactggagagaggaaactgaaagcagagcaactcagttccgcaaagagatgcgcctacactgatatttttgcacaggacattccctagagttgggcttgaagaggagaggaaaaatgcttccaagtggaagtcacgttggctaaactgagttcctacagatgagtgtcttttttccttcttctgtgtcttttaaccagaaatctactgacagaactatactttccctgaaacagaaaagacctttaatctccctttgttttcagaccattctctctaaggacttcaagggacaggtataccaatgttatgtttcctagggtggagctgattatggcctgtgtggttaggttacatgggaacataggagagaggtagagaaggcacacgaccacctctgtaacatacaaatctaggtagctgccatctcctggggagagcactgcaacctactggaagacacatggacttgaagggtaataggtgccagaaagtctaggaataggaacagagatacagcatttgaactatttatccagcaggttatagatgacgggaattctgtcaagagaataggattccgttcctgctgatgagtacctgctttgttttttcttaatataggatgtccaaatgaggttgagatgggggaatttggcactgggaaggagacccaagagggtcacataaagaacactaagtgatattcaactaacctttttgaaaagtttcattgacaaaccagtatcagaacagactactttaaaaatcctttcatacagtgttcccagggacagtacacaggcatactctgaattcaatgaaaacacaaagcacagcagtgtaagaaactaatcatgggatgttcgcttgattttatgctttgaagtaacactgagctttagatgaaagtgagtgataataggtcccatcaatattattgaaactctaactcatttgctcattaaatatttacaatccttggtaacataacacatcctcaactcttaaagagtatctacctgtcatcctttcatcatataaactatgataaatttcaaccagaaaagtgaacccctcaaaactgtgatttgtagagttcccaggcagcccagagtgccttggatataggcgatttgggaacctgttcttacaagtgacctctaaggaaggtttctccttcaagagcagcagatatataaaaaataattcctttctctggactcatttcaactgataaatgccaaggtaggcagttggatgctaggataatctggccataaatcatgattcagggttataaacaaagtgtatgctttattttgttgtggtggtggttccttcataactaggaaaagggagacaagctttcttacttttcaacaaaaagtttctctatctataatcatttacatgctgaccttcttatataaatacacaaagtgactcttaggaacatgtaaatgattataggaagttaacatataccaatgacttatttgccaccaacattataagtaggcttctagttactgcagcatattaaataatggtatcatttgtttttctgaaacagatgcaaaacactgtggtcaattttttttttttaagatggtgtcttgctctgtcgccaggctgcagagcagtgatgcaatcttggctcactgcaaccacattgctaccactgtagccgagctgtggtctctgatgtcaccaccagctgcagcgaggtaagccacggaggcgcaggctctggctccagcctccagcatgcagcggtgtctcttccttctcctcgtcttccagcccggcaggagaagctcccgctgctagcctccctcctaccgctccgtcaccaacaccaccaacagggaggcagcgccctaggctccaggctccaggctccagcgggtgaaaactaatggacccttctagttctctaacccaggtacctagcagctgagcacaccgacacagaagacccaaaaatgacgcaccacttcctcagcatgctttatatactgaagttacggatcctggactacatgttctgattggatgagagaaaaacctctaggcctactctgattggactttattttcatgctgtgattggttatcttaagacttgctctcatgcaatcagaacatgaagtctaggaaccggcatgcgcataacctccgtatataaatgatgctgaaaagctgttacggttttttttttttagggttcggtgttttactgttgagctgctcagtgcccagcttagaggaccaggaaaaggagtcaccggccatatgctggaggcttgagacacggcacagcggcgcagctcgcctcgctatggttggtggtggcagtggagcttgcgattgccacgcggctggaggggtaggaagaggaaaatcgttttgggatagatagaggggtgggtaaagagtttggttattgccaaagggaaaaaaggatagcgaggaggagaaggcgttgcaaaaagacgatggggaaaagatggtggggaaaaaaggttttgggtagatggaggtggaaagacagggtgtggagcgggagtgagggaaggttttgcagaaagacggtggatagaaagtttatgggtggatgaagggggaaaagatggtggcaattggggaggggagagagtggtgaggtgggggaaatgggctagcagtagggagagagggttttgtgaaaagacagtggggagagaagtttttgggtagatagaggagcagaagaagatagcaagtgggagaaggaaaaagggtaactagcgggaggaagacaaggttttgcgaaaaaacagtggcagaaaagaaagatggtggcgaaaagacggtaggtaaaaagtgtttgggtagatggaggagggaaagagggtgacgaggaggagaaaggagggtggcgagaagggagcagggaaagaagggtgggaaaaagacgggaaaatagtttgggatagatgcagggcaaaaaaaagggtgacaagcaggataggggagagaagaggacgagtgggaagagggggcagactttgtgaaaagatggggaaattttggggggtagatggggggaagagagaggtgagcaggagtggggagaaggctttgagaaaagatggtggggaaatgtttttgggtagatggagaagggaaagagtggcaaggaggagcaggaggaaagacaatgaggaaaacagtttttgggtagataaagggggaaaagagggtggtgagcagcaggagtagggaaaaggctttgggaaaagacggggggaaaatgtttttgcttagatggaggaggaaaagggcatgatgacagcaggagggggaaaaaagagggtggccagggagaagggggaaaatacggtgggaaaaaacgggagaaagtgtttgggtagatggttggggaaaagcgtggtgagcgggagaatagagaaggctttgcgaaatgacgggggcgggggcggggagaaaacgaaatgatggtggggagaaaacggtgaaaacgtttgggggtagatggaggaagagaaagggtggtgagagggagagggcgaaatgcggtcgggaaaagaaggtggggaaatggtgggggacaaaagttttgggtagatttttaaaaataagattatttgtattttcacttttgagtagtttgagttctttagatattttgtgtattaacctcttgcctgatgcatagctgcaaagactttcttccattctcgggttctgtcttcattatactgattgcttcctctgctttggaaaaggttttaagtttaatgtaattacatctttgcttttgttgcttgtgcttttgatgtctatttgaaaattccttgtcctaaccaatttcatgaagcatttatcctatgttttcttctctggtagtttcatagtttcaggttctgtatttaaatctttattttgagtagatttttgtatatggtaaggtaatggcctagatgtattcttgtacatgtgggtgttgggttttcctagtacagtttattgaagagattgtccttcccgaaggtgtgttcttggggcctttgttaaaaatgaattgaccgtaaacgcgtgaatttatttatgatttctctattctgtttcacttgtctatgtctgtctgtctcattcgttcatctctcttgtctctcccccgccccttttattgagagtaccatactgttttgatagtaccatccttactataaatttgtagtatattttgaaatcaggtagtgtgatgcctccagcttttctttttattccacattcttttgtctatctgaggtattttgaacttccatgtgaattttgagattctttttctatttcaatgaagaatgtcttgtaattgaacatagattgcattgattctgtagatcacattgggtgatacacatattttaacattcttctagtgcatagagatgggatatctttccatttacttgtgtctgctttagtatctttcatctatgttttatgaagttttcattttgggatctcttgcctttttggttaagtttattcctagatatcatttttttggtaatgaaatagctttctcgatttctttcttagatatttcactattggtgcatgggtgtagtattcatttttatattttgatactgtatcttggaacttgactaatttattgtttctagtaggttttttgtggaatctttagggttctctctatatatgttcatgtcacctggaaacagacaatttgactccttttttccaatttggatgccttttattgcattctcctaattgctctagctaggacttccagtattatgatgaacaaaagtggtgtaaaagtagccacacttgttccagatcttagaggagaagagcttttaacttttccttcttgattatgttagctgtgggtttgtcatatatggcctttattgcactgagatatgtgtcttctgtactcatgttgttgagtttttatcatgaaggaatgttgacttttatttttttcagcgtctactgaaatgattatatggtttttgttgttgatttgctgaatgtgatgttgcatatttatttgtgtttattgaatcatcctcatattcctgggttgaatgaaatccacttgatcatggcagatgatctttttattgcattgtcaaatgcaattttcaagtattttgctgaggatttcttacacctctgttcatcagggatatttgcctgtggtttcctttttgtgttgtgttctggtctggtttttgtaccagggtcatgctgtcctcatagaacaagttttgaagcctttcttcctcttcattttatggggaatattttgagtaaaatagatattagctattttaaaaatgtttggtaattcagcaggaaaaccatgattcttgtgtttttctttgccaggagactttttatgactgctttaattgcattcctcattattggtctgttcaggttttttatttttattttttatcattctatcttgggaattcgttatgtgtctagaaatgtattcacttccagatttttcaatttctttgtgatgtttttagtaatcttttaatgcttcgtatttctgggttaccagttgtaatgccttctttatgactttgttttctttttatctaagttcatctagttaaaactcgtcaattttgattttttttaaaacaccccagcttttgtttcattgactttttgtattttttgtttctatttttaaaatttcttctctaatctttatggtattttttctgcgaattctagcatttgattgttcttgtttttctcattacaggaggtgtactgtcaggctatttgagatcttcctacttttctgatgcaggcatttatagctatacacttttcctcttagaattgcctttggtgcatcccacaggatttatgttgtgtttctattcttacttgtttcaataaatatttaatttcccttgtatttttttcatttcttttattggttgttcatgagcgtgtattttaatttccatgtatttgtacagtttttaaagttctatctgttactgatttctaatactattcgactgtggtcagaaaagatacttgatatgaattcagtttttaaaaatgtgttgggtgaccgaggcgggatcacgaggtcaggagatcgagaccatcctggctaacacggtgaaactccgtctctactaaaaatacaaaaaattagccgggtgtggtggccggctcctccggaggctgaagcaggagaatggcgtcaacccgggaggcggagcttgcagtgagccgagatagtgccactgcactccagcctgggagacagagactccacctcaaaaaaaaaaaaaagtgttgtgacttgttttttggcctaacacagtctgtcctgtagaataatcgatgtgccactcagtagaatgagcattgtgcagttgcagagtgaaaagctgtgtaaatgtctgttaggtccattctgtatagagtacagtttaactgatgatgttttgttgtctggatgatctgtccgttcgcgatagtggggtgttgattacggtggagtgttgaggttactctattattgtattgcagtccctctgtcctttaaagcctgttaatatttgcatctatatttaggtgcttcagtgttggttgcatatgcacttaacggctgtttacttgtttctcattatataattatctttattttttctttttttgagttaaaggctattttatctaagtatagctactcctgctttttttgtttccgtttgtatggaatatctcttatcatcccttgactttgtctgtgtatgtctttataggtgaactgagttccttgtaggcaggacataattgggtcttttaatccattcagccactctgtcttaatttaatttacattcaggattattacagataaaaacatactactgccattttttacttttttgattgttttgctttttcttttgttctttctcccttcctcttttctttctgatctctttttatttcttctctttcctccttgcctttcttcctgtctttatttgtagtgaagtaattttttctggtagtgttttaattccttggtttttatgtttagagtgtctgttgatttttgttttctggttaccatgaggctaaacaacataacaagttactttaaaccgaagaaaacttaactttgattggtctcagctactcaggaggctcaggtgggaggaccgcttgagcctgggaggccgaggttgcagtgagctgaaattgcaccactgcactctccagcctgggtgacagagtgagaccatgtctcacaaaataaataaataaataaaaatgcaatagctttataatgaattctgattgtaaatttggagatgatatattaaggtataaagaggaaagtgaaaatcataatctcattacccaaggataactacttctaatgttttggtacatacgcttcctaattcataatcccctctcttttacacacacacaaatgtacacgtaaaatagactttacacacataaaattttattgtaacattttgagaaacacggttttgtaattttttctttaaaaatattgcagataagttctgtgaataacatataataacatacatcttagttttcagattttgttttttgctcttttgggtggcaggttcgcttttggctaaaatgaatcgtctcagtatctttgattttccttctctcctctaagctgttgcttttggaaggggcgcctggatctccctcctatttacttgggggcaaacacatagtatcaaggggttttgaagacacgttgcctgtgccagatagcaacactggctgtagttctgaaaatattagcgtttttgtcctgtgattaatactaagatgtaaatgaagtggtttagatcactgtagcaaatgacctagatataactgtgtgtgtgtgttttagatcattgtagccaatgatttagatacaactctgtgagtaccttttaattaagggctcaagatttctacacagtatgttcattgtctgctttatttgtagaagtgtaaaagctgatacttgggtgatgtaagaaaatggataggttttactatcacaaggaaaaggtaatatccatacacttttgccaaggaggcatgggttacttaaattggcttctggatattggagtttgggtatgatagccttacgttgaattttttggttactgcttgataatatttatttcagtaattgtgtttagtaattgattgtgtgtgttaatgaacagtcctgtcctaaaagcaaaaatgaagtggttcaagggagcatgaattgttaacatctcctttaaacaaataggctaggttaaaatttttttacagagctttacagtattacatgtgagtttattacactattacatgtcaataaaaatggcagcagaagctctcttaactgacttgccagatggattagatctctccattcactcaataaaatgtccattttattgagtcttaatccattcagaatccatttagaaatactatcttatttaacctgtaccctgtttcaactagcaactggattataagagatgtgtattaaatattttagaagacagattcttttaaataaataaaaattatcacacaggctgtcttaaacttttaaaaaagagatctgattttagatttggttaaaatactagcctacattagtattctttctaggaaataaatattcacataaattgtttttccagaaattggccttgaatacagatttcagatcgttgaaaacggaaccatttgaaatctgcatttcctttccttttcctaatttatttcagtcgctcaataggattttctcatggaattaacttttccctctcagcgtagttacataagcttgctgttgtaatcatgaaaaataattacccatttcagcacttactaacgtggaccttacttgaagggtctctggttttaaagtcagagcacatggctagaggcagatgaagagtacttcatcattcatagccactgagtctctataatttttaaatgcctttggaaagctagatctcatactcaaaagcatgcttttgtgttacaaatcttttagtgaactacttactcaggtcataatgcttttaaagccctgtttttctttcctcagaataaactgaattacatgttaccaataacaatgccacatcatttcaaaggaaactgaattaagtaatccaagtccgggttgctgaaaactagatgacacagggtaggcactgttttggttaccgtgcaaaggatctctattagtcagcttgggctgccataataaaataccatagaactgggtggcttaattttctcacggttctggaggctagaagctgtagatcagggtgctgctgcttcggttcctgatgagggctttcttcctggcttataggttggctggcatcttgtcctcacatggcaaaggggagagtactgtagtctcaccttgtcttaaaatgacaccagttctatcagattagagtcccaccccatgacctcatttaactgttagtacctcctcacaggccctgtctccaaatttagctatattagggattaaagattcaacatataaattttgagagggcacaaacattcagtccgtaaaagaaactagttgtttaattaacaaggattgttgagccctgatatcttgttatacctgcctgtgtccttcccccattcccctccactctcatttcctcaaaaacactcagataaggatttttttcagatactgttattgttacttatcaaactacgtagtaacattatgaattataaatgttattagccattgagaaagtagctgtgcactgactgaccccaattgactgggagggctagatggtgccttctctgtggtggaagataggttggagaaatgtggttggtagcaaatgctgtctgatttgaacagctttgaagaaggctggttctagttgatttcagttctctccagatgccatttgaatctaaaccaattttctagttcttatcattacagaattgtcttctggaacaattatttctttttgttacttggtagcaatatggatgtagttttctgaatcattaaggcattttaactcatcttccattctcttattttttaagtcctttaggttgtttgagggacattcatcaaggaaaccggagaaacttaaaatgctcttccgcttctttggaacagtcacagagaaaagtgaactcctttcattcttgcagtaatttttcttgctgatgggaacagttcaagtcaagtgacatgtgaggaacattttgtgtttaacgtaaaccttcctgtcccaactacattgaaacagtaatgatgcgacaaggtaacttcggttttatgcttgtgttgtgtataagcataaatgtgtgctataaatgtaggggggcggggtttacatactctgaaatcggacacatattctatacatcaaaacattttcatgaataaaaaccagagaaactatattgaccaggaaataaattttggatgctctttatttaaagaagcattcactagtttatttgtataagtcaactaacgcattgcttttctacccattcctctcttttgtgcccccctaagccctttgtggagttctcataaaactgttttgtactgagttttatatccatcttcctctattgaaccttaacattcttgcttccccaaaacctgaaagcagctgaggcagtaatagtaaatgtccaacaaatactggtaatgaccaactgataatagattggtattgccactcttatctcagaagctgaatgaccgtggtcaagtttcttgacacctctaagcttcagttttatcacctatgaaataatataataatggttattatcttacagggtagttatagatattaaacaaggagatacatgcttaataaatgtaagctattatcaatgggtagcctttcctacaagtggatgtaaaccagaacaccttaaaagtttctttgtgctaagtaggtaatgtcaacctggtcaagtgaaatggctttttttcagttctgggttgtaggattgtcttaaaacatgtctttgaacaattttaaggtcatttttctcatatccttcttttactcttgcatgacagtgtacttggcatcttcccccttgaatgtattgctattggacattgttaaatttttagaatgaaatcaattatcaggattttaatatttaagggaacattatatgcttctctgatacggaattatttatctcatagcttattgaatttcagttttgtgccctgtactgaatgaaatattaaaatgcagaatcatttggacctatgagacacaaaatcaaattagaatttgtaatgacttgttaaaaagatgactacgtaaggccaggcgtggtggatcacgaggtcaggagttccagaccagcttggtcaagatggtgaaaccctgtctctactaaaaaatacaaaaattagccaggcgtggtggcaggagcctgtaatcccagctactcgggaggctgaggcacaagaatcacttgaacccaggaagtggaggttgcagtgagctgagattgtgccactgcactctagcctgggtgacagagcaagattatgtctaaaaaaaaaaaatgactacttttttttggctattctaggtctaagtagaattattactgttggtcttttttgttttgtttttacagtactttgagttgccgttttaagtagaattgttataactaagtagtacagagtttacttttttgtcctgggagtcaaatcatgtatgtcttctctaaaaactaacttggctttctacattttaggatttcagatactttgaggaaaaagctaaaagtttgttttttaaactagaaatgtatatgccattataagtatttggaatttgaagaaataaattataactagacattttattttctgacttttttactgtacatgttaattaagttctttgtagaaatacagtacaacattgctcttggtctgcagtatgtaaagctaacggtttaaagaggaaatcctaaagagaataaaagaggttgcagtataatgagtcgttgtgtagaagttctggagcctactcaatagactggagaagcttatttaaggtaccatatttcatcgaatctaagatgtcatagattatttttaaaaagtgctattacattatatacctctaagaagggaaaaacactcaggacagggagtttagtaggagacctaacccacaaggctggtacacctagggataaatgagaaattaacttgaccatccagaaaagggaccataaagaagcatgcaagtctcaaccttgacactaaatagagaaagaaaaaaacatttctctgagaatttgaaccacaagccctaagctttgggtgtgcagccttaccaccagtgtggtccacaaaggcctgccacaaaggattaattcagatggtgttgggctgatagtgttcccagatgacagcagaagcagatgcacaccttctctgggaaaattctcctctagtctagacctatggtaagatacctccattataaaagatgtattccagtttcagaaatgtagtatgtggaaaaacccgccttttagaattgataaaatagaattccatcaggaccaacttttcagtgttgttaaacgtgtattttatatttgatgaggatcttgagactgaaatgttttaaaaagccttctgaattaaattactttttatatagttttagataaagtatcttatagatcagatttttgaaaatttatgacctgtatgtagtatatattgtgattttattatgggaagtatttgattaatcagagtatcctattctgagatgaaagttgccttgttatgaaaaagaaagctaacagacatgctctcaaggcattttttgttaatctgagaaaccatgttcttctgccttttcttgctttgccagcagtgtttacgaatttctcttagcatctcttagtatatatgaaggacatttggtgttcttacttctctgctaagttaccgaatgacaagagagatgttttctattatattcatggaattgcatctctagtgttagagttgtttgaccacttactcgtgagttttaaatatgttatccgtttatcttaaagttagatatctaaagaatgtaagacctatgttaacaaaaaattttgttttcttctgcaactgctccgtatggtttttgagtggttcctgcttttgactgagaacaaggaaatgtggaattgtgcataggaatgaaatgatggccaggctttcactgggttatacactgtcatcagtaatagttcctgacatctctctctttccttaagagcttttttctattcaagaaaacagaaatggcatagcctttttagtttgctctttgatttgagtcagacaaattacttctggccagctgatatatttgtttcttttgctactagctttaaaaaataaataaatctgactagaaaaggatctcatcctcttaaaattattgactacattaatactactccattttgatcctcccaaatgtattgcttcttgaaaaatatgtcatctttattctgtaaactcttagaaccagtaatttcttctctggctaagactgctactaacaagtagagtgattgcccactatctaagcctgaaacttagctttactaacttcagaggatgtgcaaatgattttctttttaaagctgtggcatttcactttactacaaagtacataaatgtgtctttattcaccagtctttgaatgtagggttaagtcctttctttgtaaaggagtctacaaatttgaattcagttttgtctttactgcataagctgtaccagttatacatcctttttttcaatggttttgtttttaaaagtgtattcagcttcaaaactttaccaaaaagtaccagcactcaaatcctactgttgtgctgttatttgtatagtttcgtttagtgaagtcttactgttttataggagtttctactgtaaggataatattttcaatcaatattctgttattttccaatgctaggctttgtatttcctggttagttttatagtcaatgttagacctattcttttatcgagtgtgtgtgcgcgcgtgtgcacgtgtgtgtgtataatgttttcaaaattgaaacttattttgggtatgtttttcttttattgcttctgtagaacctactgggttggtgacatttacaagacagagtcttgaggattttccagaacgggaaaggtaacaataataataaaaataatcctagacccctagaattagaaggactcttgcactatgagaggattctattttagagcacctggaaagatggttttccaacctctatcctagtgccagggaatttcttctcagaagtgatccatcgatagctttcatttttgaaaaggttatgccttttaaatcaaagtctgtaaccctttgatttctaccattttgtcttggttttgtcttctgaaagaaagcggtgtttaaaattgaggagtgttgtatgtgaagacactaataaaaggaacgccaatatataaacgtttctccttaccctttttttggttagtgtttgaactttatggcttttctttctggaggacaagattgagaaaagtctttttattatttacattttagtaaatagtaaccgtctagagtttgagtggcaagaattttgaagtttggctgcccttgtgtactactggtagattttctgcaagttgctatttactgtttgtttcttatttatcagaaaataattgaggagatagcagccaatctgagctaattcagatttgtaaggtccttagtgtcctgaaatagttaacatattttttaatctaaagcaagtcccccaatgcacttaaagaagtgtggattaactttttaaatatgtttgaggacatggtgaagcatactaaacacatatttaaccaatgcttcccattttcactttctaataattttatgatagtttgtaattgttttgtttggaattagtgatgaatggaaatcacttaaaaaaaaaagttgagaagtcatatctgcttaggtggctttcctgcggtgttttcatccatcaaagatgtttatttgtgaagtgaaagataaagaaatttactccagaagactgagtgtatggtttaggtgattattaatagagggaagtagataaaaggttaagaaacctgaagagagaaaaaaaatgagccagaaaaagatgagagcatgtacagcattttggcatcatgccatgtcagatctgaaaggaaccccagccgcctactaaaactctcgatagctctgtaatacctgcaacagttggagactggatagcttcagtgacggcaaatccgctgttgcacatcagtttgttccattggtggctgcttgtgttatcatctcatgctttcattcactaaaaatgttttctacattcattctccactattcctggttcttccttctagagctatgtaaataaatctgaatttctagttttctttaagatttgaccttccttcatgtatcttaatggcttcttgacctactttcctctccaaaagtgcatacaagttcatactaaactgattcatttcttctatttcacatgtaatatggagtctaaaccctttatctctgctcttaacagagtagattggttgcagtttcttgggtgcaggaatgaaaaaatgagtacatttgcctcagcctcccatatagctgggactgtataggtgcatgccactacacctggttaatttttgtattttttggtagagacggtgtatcaccctgttggccaggtttgtcttgaactccagacctcactgcctgccttggcctcccaaattactgggattacaggcataagtcgctgcgtctggcttgggggagttactgttgaagtattgtctttgtatcccaaagcaggcccttctgaaactgatgatgttgatgaaaaactccttctactgaagtctttgcaatgtataatcttttcacttccattttcctacatactgtttctattggttccttgtattccacagactgtgttttagtatttataagtatagtgttccttttctatgtggaaaagggaaaatgtattggcctttttttaacatataaatgaacttcacaagcaacaatttttcaaatcagttttccctgttgtgaatctcgaagtgggtacatgatgcactttcccatttaaggtaaagtacacatttatcccttatctcagaacagtcagaagtcaagttcttattgtatggttagtaatgcaaatattgataaggtcatgtgaatacttagtatttagaagaattctgaaatagcacttgttactctgtaagttttatgcatttattactttttttgaattttttataatgttcccaaacttgactgccttacttctatctcttctggcctcaagtacaacaagatgtattttctttagatttagcatataatataaattcaattgtttattttagattttgaaagaacaaagaggaactacagaatcattgcttacattgacaccggccctgttgtcccaatggatgggttttttttggatgaacgtcaaaattgaccctgctgttaaagcttgaaacttggatctgttgtatctgagttctctcctcaaaaaaagaccttcaggaagtatcagataactgaaacataccagatcacagcaccacatgcctcctgcccctccctaatttctgttctcttatacattgttaaatttttttcctgcccctattagtcaagcccatggatttgagactgagctcccagctcctgggccgcagcaccaggttaaagctttcttccttggcagtacttgtcacctcagtgactggctttttctccgatgagcaggaggacctggacgaaacccctagtgtttgggtaataacatgaacgaccatcttaactgttattctttattgaaattttactttttaactactggcctcttgttcattatctcccattcttttgacttcatatctcttttttcattgactttacagtcaaggaacttgatgctccctaaatccaaatattacggttaaaagaagagagaggaaatgtgtgcagagaaagtgtattttacaaatgaattaaaggtggattctgagttacaggtttatagatttacctagagttttgagttcaggtgagttttcacaatatgcagtaagtggaaaagaatcccaaaataattgtgacatgaaaaagctaggtgttgaaaaccaaaaagatttcactttggtatggcacttttaattcaagaatactagccaccaaatgagtttttctgactgtaatcattgctctttaaaaattgagatgtatttataacttttgtttgacttttagtacagcttctgaatttagttatcaatagataggacaaaatagatgagcatctgcttcccttccccctaaacaatgtattcttaccgaaatgtaatatatttttatttatacttgaagacagtgtttttcaatcttttccatgttagtagctcagatctttaaggacagaggatgtgtactgggggcagtttgtggtcttaatcctaagtggcactctgatattttagattatttctttcatatttgtgagtaaaacttctgctccagtaggatgagcctgtttaccttgtgactgcctaacagatctgttgctttatatgccagtttttagaagcaggcagattacgttacttggattaaaatgtttttgacactaaaggtagtatcttaaatttttacatatgagttactttaagtacaactttgcttaaattatggggatcgagtttccataactttcaccatagtgaaaatggaaagcagggaacattccacagcaaatcctgaacttatttacagagttaattgagcaaagcaggcattcacacttgtgtgtgtgtgtcagtgacagatgagcatggtacttgaagcataattgtgctgcttcagattccaatatccagtaattttatcatgtagctagagtaactaatattaagtccccaagcctacttgggtctactgtatttgtattttaaaagaatgtttttaagctaccaaatagacatgttatatatttcttctgaattagaaaacgttatttggattaatagagttaatagaatcatattttatgtttattatgtcttttttttttttttcctgagatggagtttcactctcgtcacccaggctggagtgcagcgacgcgatctcagctcactgcaacctccgtctcctgggttcaagtgattctcctgcctcagcctcccgagtaggtgggattacaggcccccgccaccacgcctggctgatttcttgtattttagtagatatgaggtttcaccatgttggcccaggctggtctcgaactcctgaactcaggtgatccgccctcctcagcctcccaaactgctgggtttacaggtgtgagccactgcacctggcctattatgtcttaaaagtgcttgcatcgtcacctagattattttttatctttcaatgtgagtttttattggtttatatgttgtttgttttctttttaggaagccatcattctttagagggcaatgaccaaacagtaccagcagaaattgaagtaccagcagaaggctaagaaggttaggagaaaaagacattttgtattttactgtttttttcttttttttttttttagacgaagtcttgctctgtcaccaggctagagtgcagtggcacgatctcggctcactgcaacctctgactccctggttcaagtgattctcctgcctcagcctcctaagtagctgggattataggcacagaccaccacatccagctattttttgtatttttggtagagaccagggtttcaccatgttggccaggatggtctcaatcttttgacctcctgatccacccacctcggcctcccaacatgctgggattacagatgtgggagcttggccacctcctcttgggagaaatgcactgattctggttgccacgtggatttattttgggagtgatattcatctaacttcatggaaataatactagatagagaattcatccgctaactttctatctgatgagagttttgggcaaatcgaataccaagttaccaagttttgtttttttctctgatgcaaaaaaacaatttgccagccagtgaaaaactctcacagctctggatgtgagtttaggatactggatttctaccattcaatttcttactacttttcttgcacagggatcatggcacaagctgcagtttccaccctgcccattgaagatgaggagtccatggcagatgaggagtccgttgaagatgagtccgcagagaacaggatggtggtgacattgctcatatcagctcttgagtccatggtgagaccttccgttctaacattctgtaattgggtagtactgggtggtagataaggttgatttgtttttgtagaatttataattttatgatttatagttctaatgagtagatctttttcttgaatagtagttatggtcaaacacttctgaccaaatgtgccatgttgtccagcctggtctcaaaatttggggctcaagagacctgcccaccttggcctcccaaaatactgggattacaggtgtaagcccctgaatctggccagatatttttctttttatggctgaataatactctgtgtatgtatatattacattttctttatccattcacctactgatgggcattagggttggttctaccttttggccactgtgaataatgctgctgttaaacgggtgtacaaatacctgtctgagtccctgctctcagttattttgggtatatacacttaaagggtgttggtggatcatataattctgtgcttaatatttttaaggagctgctaaaccattttccacagtgggctgtaccattttacattccaaaaggcaatgcatacagcttccaatttctctatagcattgctgacagttaatattttctgtttatgtactgtatttttatagtgtttgaaattaatctgagggtttttgctgataccaaaatattaggaaaggttttccaaaaataatactgcttattataaagaattttatgtgttacttgatgccctgtgatccattttctcagtaagaagaggaacttctcggctgggcgcagcagctcatgcctataatcccagcactttgggaggccgaggcaggtggatcacaaggtcaggagttcaagaccagcctggccaacatagtgaaacccagtctctactaaacaaacaaaaattagctgggtgtggtggcgggcacctctaatcccagctactcggaaggctgaggcagggaattggttgaacctgggaggcggaggttgcagtgaccgagattgtgccactgcacccagcctgtgtgatagagtgagattccatctcaaaaaaaaaaaaaaaaaaaaggaaagaagaggaacttctctccattcaacctcattccactgcaccaactcttctgtgtcgggttgtgcaggggagaaagggagcttggcacctctttgctgtgttgagttgtggtagcccatcactgggttgtaaagtgcattgcctcctccccccccccctttttttttgagacagagtctcactctgtcacccaggctcaggtgcagtgctgagatctctgctcactgcaacctcagcctcctgggttcaagcgattctcctgcctcagcctcccaagaagctgggactataggcacgtgccaccacacctggctaattttttttatttttagtagagacggtatcaccatgttggccaggctggtgttgaactcctgacctcaagtgatccacccaccttggcctccgaaagtgctggggttacaggcatgagacactgcgcccatccacctcctcttttacttgggagaaatgcgcagattctgggtgccatgtgcatttgggagtgatactgatctaacttatggaaataatactagatagaaagttagtggatggattctctatctgatgagagttttgggcaaaacgaattcctagtttctgagtcttatttttcccctgattcaagaaaactgtgaattatccagccggtgaaaaactctcacagctctggatgtgagtttaggacactggatttctaccactcactttcttactacttttcttgtgcaaggatcatggcacaagttgcagtttccaccctgcccattgaagatgaggagtttgttgaagatgaggagtccttggagagcaggatggtggtgacattcctaatgtcagctctcgagtccacggtcagaccttctgttctcacattctgtagtttggtaggactgggcagtagataaggttgatttatttttgtagaacttacaattttatgattttcagttgtaatgagtagacctttttcgtgaatagtagttatggttaaacacctctaaccaaatgtgcatgtggagtttctacactgattttcagacaatctggatcccaactgggtatcccacaattccatcctgacactccctggagttagtgcagaccccgcaggatggggtctcagtcccaggagtctaccctcactccacatgccaattgcaagtcttgggttgttacatgtagttttgaccgaccagttagaaaacagggtttcatgaccccattgctgggtggaatcatttgctcggacagcttgcagaactcagaaaaacaggttgtttttttttttttctgagatacagggtctcagtctattgccagactggaatgcagtggtgtgatcaaagctcactgtagcatgggactcctgggctcaagtgatcctcccacctcagcctcccaaatagctgagactacaggcccgcaccagcatatctggctaagtttttttattttttgtagagaaggggtcttgttatgttgcccaggctggtctcaaatttctgggctcacatgatcctcccacctcaacttcacaaaatgctgggattatgggtgtgagccactgcatctcaccaatttactttcttttactggttcattttaaaggctatatctcagaaacagccggtgaaagagatgtacatgctgggcacagtggctcatgcctgtaatttcagctctttgggagactgaggcgggagcatcgcttaagtgctcaggagattaagaccagcctgggtaacacggtgaaaacgcatctctacaaaaaggtttttctaaaaattagccaggtgcagtgatctatagttctggctactcagtgcctataattctagttactcaggaggctgaggtgagaggatgagagatggggcttgagctagggaggcataggtcgcagtgagccacgattgtgccacggcactctaggctgggggacagagccagaccctgtttcaaaaaaaaaaaaaaaaaaaccacagggcaaggtgtgtcgggaggtcgggaggggtgcagaacttccatgctctctattgcgcgtgttaccttcctgctatctcccttgtgttcagcaaccccggcattctccaaatctggttgttgaggtcatttatgaaggcttctttaagcaggcatgatagatgaaatcattgactattggtgattaagtcagtcttcggccactatttcttcctggagcccagtgggtgaggctgacagttccaagcctctaatcacatggtttgttcttctggcaaccagccctttttcttaagcggtctaggagctttcagtcacccagtcatctcagtaacatcaccaaatgcattcttactgtggtgatcccaaaggtcttagaggctcttgtgttagaaacctgggactaagaccaaatattcaaacaaaagatggggtcctatcacctttatcaccaaggcctttataagaacttgagaagctctgtgccaggacgaggggcagaaaccaaatgtgtattttttttctttttcttttgaacacagagtctctgtttcacccaatctggagtgcaatgatgcagtcgtagctaactgcagcctcaaccacctgggctcaagcaattctcccacctcagccttccaagcatctgggactacaggtgcacaccatccatgcccagctgatttttgtatttttttgtagagatgggatcttgttatattgccgaggctggtcttgaactctggggctaaagcaatcctttcaccacagcctctcaagtagctgaaactacagatgcataccaccatgcccagctaattttctcttatttctttttgttgtttaattgagggggggggggtctcactgtgtttcccaggctggtcccgaacttctggcctcaagcatttctcctgctttgacctcctaaactgttgggattatggttgtgagccccggcctctgtgtccagcaatcacaagaggtctttataagtgaaagagggaggtaagagagtcagaattgaaggagatttgatggtggaagcacaggtcacagagggagatttgaatatgctttgcttctggctttgaagatgcatttaggggccatgaggcaaagaataggggtggcttttggaactgggaaaggcaagggaacaccttctctctggaacctccagaagggatgcagtcctgctgacaccttgactttagccttaatagacctattttggacttctggcccccagacctgttaggtagtagatttgtggtgtattaagccactcaacgtagggtagtttgtaacagcagcaagaagaaatgaacatgaagccaggggtagtggcccacacctataattccagctatttaggaggctgaggcaggatggttgctctggcccaggagttcaagataagcctgggcaacaaagtgataccctgtctacatgggaaaaaaaaattagcgggtgtagtggcatgcacttgtagtcttagctactagaggcgctgaggcaggacgatttcttgacctaggagttccaggtctcagtgtgttgtgatcgtgccatggtgccccagcctgagtgacacagcgagattatatcttaaaaaaaaagtaaaaagaaatgagtgagcatggcaggaatggggacacatagcaatattaaatagagtggtcagggttggcctcctaagtgaaaattgagcaaagacttgaaggaggggaaggagctggccaaggtactgagggaagagcattataggcagaaacaacagaataaagatgctaagagggaactccgtggtgtgtctgaagctcaggaaagaggattgtcgagcagagagggggagagaaggtaggggaggaggccagggagttgtgggactcagatcagtacagattgtgcaagccctgggaggctattgctggggctttggcttttatgctgtctgagatgggagatgcggaagggttctgagcagagaggtgacacgaactgtctattgatttaaaagcatcccatggtggctgagttgagaaagattgtgggaagatttgggtagaagcacggaggccaagctgtggcaacatccaggtaggagatgatagtggttctgaccagggtcctggcaatggtgagagatggttgattcttgttgagatactaagtaattaaaaaaaaaaaacactactgcttttcctgattatatgaagtatgggatgctagattaaagacatcttaagtcgggccaggtgcagtggcttacgcctgtggcgtcagcactttgggagcactttgggaggcacagatggcacagatgggagaattgtttgagtccaggagtctgagaccaccctgggcaacatagcaagacctcctgtctatgcaaataaaaattaataaaatataattatcatgggatagtggtattttcctgtagaaccagttactctggttgtcgagatgggcagatctcgagggtgggagtttgaggccagcttgggcaacatagcaaggctcctctttctacaaaaaaaaaaaaaatcatctgggtgttgtggtcccaatgagggacagcattcctgagactttttaagtactttgtgtgatggtctaataatcatagccttaaaactttctggctgggcatggtggctcacacctgtaattccagcacttcaagaggccgaggcgggtagatcatctgaggtgaggagttcgagaccagcctggccaatatgtgaaaccctgtctctactaaaaatacaaaaattagccaggcatggttgcagcacctgtaatcccagctactcgggaggccaagacaggagaattgcttgaatccgggaggcagaggttgcagtgagctgagatgggccactgcactccagcttgggcagcagagtgagacttggtctcaaagaaaagttattgtgatatgctgtacacattcacaaattcagtgtctcccagaagtgtgagattcttttttttttttttttttttttgagacagaatttcactcttgttgcccaggctggagtgcaatggtgtgatcttggctaactgcaacctccacttcatgggttcaagcaattctcctgcatcagcccaagtagctcctgcctcccaagtagctgggattacaggcatgtgccaccatgctcagctaattttttatttttagtagagttggggtttctccacgttggtcaggctggtctcgaactcccgacctcaggtgatccacccgcctcggcctcttgaagtgctgggattacaggtgtgagccaccatgcccagccagaaagttttaaggctatgattattagaccatcacacacacacaaagtacttaaaaagtctcaggaatgctgtccctcattggcctggtatgacaaagataagaagtcggtcgtgaaaatttctgaacgtggtttaggacaaggaaccccagtaagattcagagacaacctagaaaattgaaagaaaattttactactgaaatcatccttctataaaaaataatagaagatgtcaaatatgaaaataaaactgtcctctgggccctcaattttctgtgtcatgggagaaggcagacagctactcagcagttatatcccataagaatggataatactaaaacaactgacagcatcaagtattggttagaaagtggaactgattctctcattttcattgtagtttaagatggcataaccacttaggaaaatgtctccccatttcatacaatgccaaatatatacttattttataacccagaaaatccactcttatgtacttaaactcaagaaaagtgaaaatattattacagaaaaaaatatgtatatctgatttgttcgtagcaggtttattcatgatagcctcaaatcagaaactgcttttgtgtctatcaatagtggaatggattaaaaacaaaacaagcaaaggcctcaaacctgtggtatagtcataaagttgaatattagaaaataatgaataatcaataggagcaaaatgatgtgtcacaagcatgtttagtgagtgaacataaaaattatataatttatagtttcacttacataaatggtgaaaacagacaaaactaaccttttgtggaaagaatcaaaaccgtggaagcctctgtgttcaaatactgactggaaatgggcaggagaaaacatgtttctgccagatcttctatatgcctgatgtgcattcactcgatgtattttgcgtatactatttttgcaaataaaactgagataaaggcaaaataactcaagagaagatagatagaaataggtagagttgggatagaagccttcgaagctacccccgtaccttgcccacctggcacaggccgaggaagtcctgggacaatgctgtgagcgacctgagggccgtccaggggagccccgccagcccatgctggcgcctgagctgcccgccgccatctgaatatgttgcaaagacagtgctggcctggcaaccggtgacgccccaccccgacccccacttctacccaagtagtggctacgctagagacagattcctgggcggcagcggttaagtctggcagttggccaggtggccaaaggacgggaactggccgttcaccccatcccagttccacagagaactcaaccactatggcccctgagcggaccttcaggcctggtgggctgtgctctgtgcctgcaaacctgacgccatccaggggagctccgccttcccgcgccagcgcctcggctgctgcagaaaactgcaaaactgcaagttgcacacgggcagagatgacggagcaacccccgaccctccgcgccactcaccctacctgcacacctgccgcgcggaccctggggcgggtgcctgggtgcccaagtcaggcagtccgcacagcagtggcaccagggtgaaaacctgctgctcggtaccatcccggttaccacgaagagccagtcccggcggcccctgcgttcttggaggaggccaagtcagagcaacctctcaagtgggagggcgatgcacttgaccctgaggacatcaggtaccaggcccgccagctcacgcctgcatcggagccgcagctgcagtctagacgtggtgcaccggcagcaagtgactggacactccagaccaggcccgccccgcagtagcgtggatcctgaggccagacccccaggcggcaaaatcaggcaaccggccccgccagcagccgctgtttcatccgtgtggacacagagtgcccagcgccagggcccaggatccagaaagatgtccaagaggagcggaccttgaggccaggtgggctgtgcgctctgcggccctgaggccatccaaaggaagctccgccatcctgcgccagtgccagatctgcagctgcaaaccgcgcgtgtggcactggcagcagtgagggcgggtgggggaaggagcagtccctgactctgcctccatccctctccagctacctgacactagccacacagacttcagggtcagagcctcagcgttcagccaatccgcgaagccactcaggtggccgcggagtgcccttgccagcaccctatctcccttctgaggaggagcggggcgggctgcaaggccagacaggccctccttctcaggccgggctggctgcgcgcctgcgatcctggggctgcccgggcgatcccaggagaaccggcgagcccatcggcgcacgcccagagctgcagccccacctgctggcgcgcgccgccagggagcgtcttctgggagcccggcagcaactgccgtgcaggcgcgcgcccaacggctttgcgaggctcactcggtctgagaggtcggaggctgcgagtgtcgctgctgaaggctgtggtggaccgggctggatcgcggattgtgtagattatagatttgaaatagcggagttggggttggatcggggctttggggttggataggggatttggggctgggtcggccggggtcggggagggggttggtgaaaaggtgacagggagctgccctcgctcaagagccggtggttgggggtctgagaagaagtcaccaatatgaagttattcggcttcgggagccgcaggggccagacggcccagggctccatagaccacgtctacacgggttccggataccgaatccgggactccgaactgcagaagatccacagggcagctgtcaaaggcgacgccgcggaggtggagcgctgcttggcgcgcaggagcggagacctggacgccctggacaagcagcacaggtagcgggggctcagcccggggtgggagggggcccccaggcccggcttccccgcagaccctgggacggggccgtgcagggcgccgggcaccctcggagcggcggagccaaacggactctcagctgttttccatccctcataattccctggctggagcagttggagaatttgagtgatttaactcacaaagttaagcatatacagcgttgttatttttaacgtacacgtttaaaacatggtttatatacattataggaggtgcctaatgagagtacttgttcccctatcaaaaataaccgtgagttgtttcagtgggcgaaaagttctcagataagagagcttacttgaaaaatatttactatattatatatatatattttttcagatgaaaagtatgttttcattttatagggaattcattatattctttttttttttttgagtcggagtctcgcttctttgcccaggctggtgtccaatggcacaatcttggctcactgcaacctctgcctgcccggttcaagcaattttcctacctcagcctcccaagtagctgggattgcaggcaggtgccagcatgcctggctaatttttgtatatttagtttcaccacgttggccaggctggtctcgaactcctgacctcaagtcatctgcccgcctccgcctcccaaagcgctgggattataggtgtgagccaccgcgcctggcctatgttgtttattatatatcataagatatatatatatattactgatatgtatacatatataacacatataatatgttataaatatcagttatatatacacattagatgaaaagtacctcttcattttacagggaattctttcaaatcaaattatcaaacactctaaaagtgggcaaagtacctttttccagatctacaagttacttatatacataggaaaaaatccttcgcatttctggtataagaatttaaactaaaagaggaatgaaacagttttctatccacaatatttgtgaggatgttttatactgctgcttaaagttgctgattacttttcaaagtactcatttgaaaatggtaagtactacatttaaaaaatgtgtatgccctttacccaccaattccattatactaaaatacccttaggaaataaagatacatgcactttatttttcacagtacttattttaaagagaacccatagaatggatcctataaataaatttcagttgcatccataggatggaataatatgtgaccactgaaggtggcaatagatacagaagtacgttgatgtgcaaagatgtattttgttatagctagcaaggagaaaaaattagttaaattatacatacacaaacatactatggtcttgttttagcaaaaatatgtacaaaatataaaatttgtaatttctgagcatttgtattttaagtaaagtttttttcctttttcttatctgtgattgctgcagtgagtacaaaacttctagtaaaagtttattattaatggactaatccttgggaagagaggaatatgaatcttgtgctgatgaaaataatttctcactttctattttttatcattattgtgtgtgttgttatcttctttgagcttttagcctcttcagaagtaaaaagggaatgtttttatctgtttccagattttattatctatatattttattatgtacatatgttttgcttatatactcgttccatttatgcaaacataatcatttcattttaattgtattctttaaaaataaaacaacacatataaataattactattgcaaaaatattgctttataggagtttatttaaaaataatgaactccccaactgtatttatccattctttcattccatttatggatcaagcataacctgagtacctgctatgtagcagacatattctgtcatctctcaggacccgtccatccttaaacacttcatgtttacctgccccgcctgcacaagctgagagatttaaaataggaatattgggacttaatctccttgaaactttatctcccacctttcaaacaaaagcatttctgaagttagaaaatagtagaagataacctttaactgctctttcgaaagtttgtcagtcttaaatactaatattaatcattggaaagtcttatttgcatatattttctaagtataaatattgaatacaatgagccatatgtattcatttgaatcatgagtttcctttggcttcaagttgtttgaaaatcaaagaattaatttgtttaaaaaatgcattattgttatttcagtgctctttccccatagtacctttaagaactaaaatgtatttaagtttcagttacatgcctagaactgccctagacctgctgagtataccatattctacttaatgtaaggtctcatggattgcgtgatgccccgatattttatatatcaataagataatttttaaaatgctaccaattatagttataacaaatcatgaattataagtggcattccaatgtcagaggtgttaaaatgtgacctactcgttaagtcatcttgcaaagtaggtgtaattgtatcattctacctaattaaaatggttttgttaagtagtagtaatagtaataattataatatctggctgggtgcagtggctcacacctgtaatcccagaactttgggaggctgaggtgagaggattgcttgatgccaggagtttgagaccagcctgggcaacaaagtgagattcttactctacaaaaatttttaaataaatagctgggcatgctggtgctcatctgtagtcccagctactcaggaggctggggatggagatcatttgacccaggagttccaggtatagttacaccattgcactccagcctgggcaaaagagtgagactttgtctcaaaaaacaaaaatcttacaattattgagttgtcgtaggaactgttctgcatactttacatagcttctcatttaagcatcatgatggtgtcctatgagatagctactattgtcatctttattaatgaggaagttgaggtacagaaaggctaagcaatagttggtaagtgtcaaggcttaaagtaggactcaagccctagttgaaccgaatccaaagactgagctctttctactcaaataggctgctgttttcattaaggcagtgagcaataagagtaagtattgtactttcttcaaaaaatttatttgttttgaaggcagaggaaaaacatgctattcagtttttacattacatgaatgattgtatgttttgagatattgtactacagtttcttaaaaaatcctcttactctcatagaactgctctacacttggcctgtgccagtggccatgtgcaagtggtcactctcctggttaacagaaaatgccagattgatgtctgtgacaaagaaaacagaacgcctttgatacaggtatattagagccaactcttttagcatgacatggatttgatttacatatatagaattaaaataaattgatctcatttacatataactagttggtgaaacctgtggaatgtgtattttgaattcttggaatttacaatctgtttcttggtctaacacggacaggctgtccattgccaggaagaggcttgtgccgttattctgctggaacatggcgccaatccaaaccttaaggatatctacggcaacactgctctccattatgccgtgtatagtgagagcacctcactggcagaaaaactgctttcccatggtgcacatattgaagcactggacaaggtataggtcaatcaactttctttccaaaatatttgttttaacattgacataggtaagggtcaattttttatatttggaagctcaaccattccctgaatgcaaatacaaattaagttattttgaaataacttaattgtctaagattttattttaaatattgatacttttaaagaagcattaaagggcacagctttataaaatgcactttggaaaatatttgtgaatttgttaaaggtaaaaccttttcaactttttttctacacaggcttattctttttttttttttttttcttaattagtgtaaaacaacaaaggaaagaaaatattccccggaaataggctttatcctaaaactcaaacaaaactaaagcaacttacaataaagggacatgttgctgctgctgctaattttctgaaaaactgatgtatcatctttcagtggcaaggcttaagagggaaaaatgggaggggagaaagagagcgatcagaaatatgcaggtcacttggatattagataatgagggaaaatgccaggaagaggtttttttttgtttttaagtttgttttatgtgttgagacaaggtgctgtttagctttgggtctaataatttttggtttgaaaaagaatgagttgcaacttgcctagagatgaattttaggaggactctgaggaaaccagattggcagtgaatatgtggtgacgaagtgagaaacacttcagcagaaggtggaacaaattattaactgacttattgctcatcctggcagaaacagccacttagataagaacctaaagcctcctctcaaatctagaatgtcttagtgggaaggtgggagataaggagcttgtaaatagcaaaatcaagtgggattttgagtttacttgtccctgttctacccatagccaggaaacttaactggagttttaataaatgacactatctcttactcttttctctttttggccacatctccaactgataaaggaattagccatgtgggtgagaggtgagactgaagtgattgtctgctgcactgattctcagaattgtgcattacagtgacctgaggacattttgttaaaaatctacaattgtaggctttcccctgaagattttgatgtaatagacctaataaggcctgaacgtgtttaaaaatgttttcttgaagctgggcacagtggtgtattcctgtagtcccagcttgagcctaagagtttgaatccagcttgagcaacatagtgagactcttgtctctaacaacaataatagccaaaaaaaaaaaaccacaaaaaaacaaaaaaccttcaaggttgggatacactcttgattaaaaaccccagaatagataagtgcaatatataaatttctgtatctcaaaaatgtaagaaatctctagaagagttggcatttgatagttgccacttccttcaaagttctccttttcaattatattagcctgacttatctgtctttctctacatctgtgactgggaagtgaaaggaaatatcattggcaatatctctcagcttacagaataacatgttttgcttcccaccatgaatcattcactaccattcagagagtattcagaaatttgcttatgagtaatctttcaacaggtagaggctgaccctttcatgatttcatgtccctttgtcaccacgcaggtgattatgtgtcaacaaatgttcattacaagtttggctttctcaattaagatagtagcaaatcctaaactattttttttagttgaagttttattatgaactatctcagtatgtttgttaagtttatagaactttagcatacccaaaatgtcagttttaaacactgaaatccatgaagttaataagaatatagataggaattcttttaataatttagttttagcagtcttgtgaaccaattatctatttggttaacaatcttggaaaattatatacaaacatattttaaatgaatacatgttagaaaaattcttgaagcaggtattgtgagtctttttagcaatttttattatatatgagagcctgattttttggtagaacatatgataccagagaaagaaaatattttacatgcaaatacttggattatacacaaccatttagtaacacattaatagcgaatataaaaaaaacaagggctatattctaatgtggtacacagatttgtttgtttgcctctataagttgaatcaacatgtaaaatttagaagactcgtgaagaaatgtggacttcaggcgtatcctaaaaaatcaaatctggtgtcccctgagtttctatcattctttggtctgctgtgcagaagttgcccctttatagaaggcaggtattctccagtttgctactgtgcccaccttagtacttcccttactcaggcaaccttcctttgtccttgtaagtatctgagtttacaactcctatgttatagtatattttgataaaaatttcaaggtttttaagtcagcatgtatttgtttataatatatagtctatagagtatataaatccctcagttatggagttgaattttagagtttagaagtttttaactcttttctttatatataccacaaataattctctgcccataagaatgcctagaagcctttttaggttattcctggttatagttggataatttatgaatattgcagacagtacatccttctcctcagtgctcttccttaaggatgcaagtgacttattggcttgtattatgccagaaataatccatgtggatcagtatgagaacttctattgataagccattatgtttttatttctgatttatattttgtctaaaataaaaaataattttaagtagccatttaagtggaagccagtaaaaatggatttaaaaagtagagctgcactagggtcccgggattaccattataattgagaatagtatttcttactgagttttggtttttaaaatatttgttcttaagttttttaaacctatctctcttacacagaatatactgagctttctaacagtaaagataaaaatctcttctcttgtattaggggaaaaacccatggactatttaataataaggaaaataaatgcatttgaagccaatctctcttaattcaaagctcatttccatggtgacccatttggagcaggagtgcctgacattggcatctgggatcctgacaccattcataaaagtgaatcaagcaagtttgtaccacccagagggaactgccacctgtattgggaagctctggcaactgtatctctgaaactcttaattcctcaaatgttaatgtttgccacaaatagtattgtgaaaggggattaggtgaaattaaagagatttcttgattattggacataaaatacagttttgtaatacttctcaaatacagatggtcatggagtctttctcttgcggtataatacttctgataaagcaaatattctttggaatatagtttaagagacactgctttagagatagtaatttagatcattaattaatgtaaaaaacttaaaatatttgctactgtgtcttagggttttaggcccttgcctcaagaagctcttggtttcagtgggaaacaatgaaatgactacaatgtaccatgataagtgctgtgatcaaagcaaggattcttgggactagtaaatgtttaaagtgagttttggcaatgaccacagttaatccagggagacagaggagggttgtttgcaaggcaaagcacagcacatcagaaagcacagaggagtgagaatgaagggactgcttttcatttacttcctttctatattgtatgttgaagttcaaagcatcctggagaagattttcagttcagttgagaaatatgtaattttgtgaattattaattttttctgctgttttataggacaataataccccacttttatttgctataatttgcaagaaagagaaaatggtggaatttttattgaaaaggaaagcaagttcacatgccgttgataggctgagacggtacagtagttctttttttaaaaataaaacctgagtattctagagtggtcactcaagtcagaaatattaataagaagattaacataattattggcatataatgaaaaatatcaccatgaataatcaggtagacaagcaaatatttggactgagtaacataaagaatagtatatagtaggattcatcttctcttataatatacagagtttggtatttataatcagatgtttttcgtactgtaatcttttattagctaaagggttttgtattagttttattaattttttttttttttgagatggagtcttgctctgttgccaggctggagtgcagtggtgtgatctcagctcactgcattctccacctcccaggttcaagcgattctcctgcctcggcctcccaagtagctgggactacaggtgcacgccaccatgcccagctaatttttgtatttttagtagagatgggatttcaccatgttggccaggatggtcttgatctcttgacctcgtgatctgctctccttggcttcccaaagtgctgggattacaggcatgagacactgcacctgacaagttttattcattttcaaagtgtggacttttagtttatgactactagcattgtcattattattattgttgttgttgttgttttcagcctgcagataactcttatctgacccctagctgatttgactaggaaagcaatggggaaatcttcatctaaatctttgcctactttagataagtgacctcagcacagtttcttggccatcaaaggactataagttagcaacttgtattatgtcttaccccagtgggacaagaggcttccctgttgtccctttcttttagccttggtgacaatttacaaagatgaacacttgagcaccctagatgcttatagacccaagctagtacatgcaaatagttattacatctatactgacaggcggatattaaactggtaaagtgtatcaaactagctttttaaaaaagtctttattaaagttcttgagtggagttatttctttgttgttttaggtcagctctcatgcttgctgtatactatgactcaccaggtattgtcaatatccttcttaagcaaaatattgatgtcttcgctcaagacatgtgtggacgagatgcagaagattatgctatttctcatcatttgacaaagtaagtgtttatgttaaaaggccagttaatgctaaattgaagtttaaaataattgcaactactccatcttatgcattaggtgagagttcatagtttggttcagatagtttgaaatagcgaagagttagtctaccttttagccagaaatcaagcagaagtctagattagttagaagtagagtgcgagattttttctggatttttgagacatttatccctagggatctcaatgttattcattttattctaagtataatccccatgcatgggataaaaagagccatgtctttgatttcttttcctttcctttccttttttttttttttttttttttttttgtagagacaaggtctcactctgttgccctggctggtcttgaacttttgaggtcaagtaatccccctgcctcggcctctgaaagtgctagccaccatgcctggcctgacttttctaattagttattgagtcttgtaatgtccagtttaacagaaaatcttgtattgtcccctggggctctctcctgtgtcttccttctttgaattttccaagaagctaaggggtttcctaagtccaaggaaggcaatctttctttacaagtcagaagaaggggaaaaaaggccattctaatcattctgttgtttccatggactcacttgctgtattattgccattataaccggtcctgcaatctgataatgattgacctttgccaccaggatgccttcactgattcagacccctcagttttcatggtgattcatatatagaggtcaaagctacggtgtttattagtttatgtacttgtgctcagtcattgttcccagcaccctgctctggcagctaggcctcctagctttatccacacaaatattgagcaagttgatgctcaccctacactaaaaaccttatttggagcccacgtcttagctagactttgcctaggccttcgtggtatgttatcctttgagagccatgtttgtctttcctttaaccaatattagttgggattgttctcaatagtcagggatgttcaaataatgttgcaggaagagatcagagttccctgtctcttttgctatcagatctgtaccttgaggcttttttatatcctgtgcagcagctttggttagatagcggaatgttccatgttatctttccactgagtagtgggaaccagcttgcagttggcccctcaagtaatgtgtctctataatcatgaaaatctcctgggctacttgcagctcttcctcaagttttcaatatattttaaaattctacctcacaggaagccattcaataaaattctctgaatctgaagtaagtgagttggatttaatagagctaagcctcatccatgactcatgaatatccatgtatcaaacagggctttgtacttatttcaacagcacatattttaaaattggatcaatacagagcagataagcatggctactgcctagggatggcacacaaattcagaaaacattccatattttgcctagtcccaggaaggccatttgactatttgttgagtagctccaaggaagcagtgtgagcaaaaccaaaacaggtgacacgcaatattgaaattgtgattatcgctatgaaactattgatgtatggtgatctctgaaatgggaacagagctgagtaataaggggatgttacatgttgttagtacatgtcttggaaatgagaaaatgtcaacttgtatttccttcatggaactgaaaaacaatcaaagcagggttttgtcttgtctgttagttggagaggaccatggagatccagcagccaagcacagatctgctggctcagagtttgaggaggtagagaaggagtggtagttgtccaagccaggttttgacacctattagttttctgcccttggtgtgattgatgagctcagtgatgagctcactaaatttatatatatagaaatttagtaataagttatgaattaggtaaaatgccctgaattacaagccacaatgaatacaagtaataaccaaaattagcacttaataacattttctgaaaactgcaacatttgagtattagaacttacagaaaaacacacaccgagcattatttgggattccaaaatggtttcagcaataaagttcaagaataaattattccattgctttactatttctctgaacatataaacatgtaatctcattacatcttccaaacaacctagtgaagtaaggtagcagaatccttgttttttagaagaaaccatggagcctaagagaagcaacttgtctgaagacaaaatacctacagagcgaggtattttggttacagagcaaggacttactctgagtgcaggacactttgcatgatatccagctaactagagttcatttactgagctgtgcttcctccatttatgagtacttcactttcttttcttctttaattataagcttaataagcttgtaaggtttacaaatttgaagtgtatgggacattaaaattctgatattaggtctgatattgcttgaaagtgttttggaatttaatatgtttggtgaatattttttatttcattataaaaatggcaattttatttattacttttgtatacatagaattcaacaacaaattttggaacataaaaagaagatacttaaaaaggagaaatcaggtaagacttctgattgtgaatttcttacttgtcttggtggtcctactcttgataaaatacaaagtaagatgtaagattaaggtagtttcagtcaaaaaagaccagtttaaaaatatgtgtaaattgaatgtgtatatatgtatatacatatgtaaattaatttttaaaatttaacttctttagtttgaaattcagatttatttaagaaggtagttgtagctaatttacaatctcaaacattattgtctgaaaacattcatttatttaattatgatccctaaaatcctatataatatttttgcataaataagaaaaaagatttttaagttagtatgttgtatgtttcctctatagtcacattataacaaattggacttgttatacaaatggatcttcgatttcatttttataataaattgtttatatttagtaaacaaataactacagttgacccatgaataatgtgggggtgagggactctgatccctgtgcagttgaaaatctgagtataacttttgattccttcaccttagctactaatagcccacaattgactggaagccttcctgataacataaacagttgatgaacacctattttgtttttgctgcattattatatactgtgttcgcacaataaaataagctagagaaatgaagctgttagaaaggaaatcatcaggagaaacatattgacttttcataaagcataagtagtcctgacaaaggtcttcatgatcttcaggttgattaggctgaggaggaagaggagaggtggatcttgctgtctctctgttgcagaggcagaagaaaatctgcatataagtgaatccctgcagttgaaacccttgctgttcaagggtgaactgtattacatattgatttgtgtcactaagaaagtaactatctttagaaccaggaactcagcaatccctttctggtaccataaataaatggcaataagaactgtagaactgaaccagtgtgcacccatacaaataggagattattttttgaagacagctactgagcacaggagacggaaaagcaattcctttgtgagaagcacaagttatattacatattcgtacacaagcaaaatgattttatctgtcatagtttacatacatacacatacacacgtgcacatgtgcacacacctgtgcacacagacacaaagttaaaagtcctgcttattcttaatgaccaaatccaactgttcacagagagcggtggataacgcatcctactgtttggatgcaattcttttgactttttgacttgttttgtgatgaactgcctttaatgggtttaaatcatgttttcagttttatgagaaatgaagaaaaagattagaagcaagtaaacaggaactctatggtcagtagtagactataatagtatattcaatagtcatatgtttttctccagttacacaatttacttgaatgatgcacaattaatcaattattattatcataggagatggggtctctctatgttgcctaggctagaatacagtgtctattcattggtgcaatcatagctcactgtagccttgaactcctgggctcaagcagtcctcctacttcatcctcctgagtagctgggactacagttttgtgtggttacatctggcctgatacacaattatttatttgtttatttatttttaatacagggtctccctctgttgtcagtactggtgtgcagtggtgtcatcttggctcactgcaacttctgcttgctggccttaaatgatcctttcaccttagcctcccaagtagcttggactacaggcatgcactaccacacttggctaattttctttttaagggatttttgtttgtttgtttgtttaatagatgaggtctcactatattgccgaggccggtctggaacttccgggctcaagtgatcctcctgcctcaacctcccaaaatgctcggatttacaagtgtgagccactgcacctggccttcaaaattattataaaaaggaatgaagcccagttgagttgcagaaaattgaccactttttcattttttttctagaaacattcatattgtagaacatattgtcaatcacccagattctctattttttattcagataaaagaggattgctgctcatttcacattattttctgacattattttttcatttattccttctatggctttattcaattggatagatatagaaatacgagaatctccaagtcaaatatcaaggcaaaaaaagaaaagaaaaacagattaggtaaagttattctgtgaaataaccatctgattacagttacacgtatcatatcaacttaatacaaatcttacacaatgaatttgtgtcaaggtttcccaagaccaccccaggtttggtggttcattagaaggactcacaggactcaacaaatagtcatactcagatctttaattgataacaaggaaggggacaagcaaaattagtagaggaaaaaggtgcatgtggtcaattctggaggaaacaaggcacaagcctccaggagttctgtcctgtggagttcccgggatctgcttaattctcccaggctcacattttgacaacatatgtgcagtgatgtctaccagtaccagagtttcattagagactaagtgcccaagtttttctatggaggttactctccctcacatgtacccaaattccagactcttacaaggaaagcagctgtttagagtaaatacactgtttctataagcactttagacacagtgagccactcttctcagggaatggtggaaaccctcccatttccaatttcctaaacaccagccaagggccagccttgcatgcaggcctttctaaggatggcagcctcttgcctgctatatgaaatcttttctgcacaacacttgtaaccccaacttaatttttggtgttgttttaaaatttcattttaataacataatattataagataaggtaacttggtactaatttctgttgtatgatccatcttaagttgcagtgcttgttacttttttgacttttggtgatgaacagctatttgtatataagttaccatagcaatgttaggtaattataatctgtcctatttatctcattaacctttcagtaaaattgttaaattaaataagcaaaataatttctgagttaacattagaataaaaattgtcttttattttgattacatgaatagtctagttttcatattgtgctaaatccctgtttagaattatgaaataagataaaatattcaattatttttatcaatattttcttacctaagcatgcaattaaatttatttattttatatattttatatagttcaatttgagaagtaatgaccacatgttgttactttggtcttcaatgatctctaatttttagggtcaccgtgtcttgcttaaatatatcatagtaacaggttcagtgaatatctttattttttattttatttacttatttttttgagacggagttttgctcttgttgcccaggctgcagtacaatgacataatcttggctcattgcaacctccacctcccagtttcaaatgattctcctgcctcagcctcctaggtacctggaactacaggcatgcacaatcatgcctggctaattttttgtatttagtagagatggggtttcaccatgttagtcaggctggtctcgaactcctgacctcaggtgatccacctacctcggcctctcaaagtgctgggattacaggcatgagccactgcccccagccatttatttatttatttatttatttatttattgtaattgttctggagatcctgggatgcatagacagtgaatatctttttgttttttgagatggagtctcactctgtctcccaggctgcagtgcagtggtgcgatctcagttaactgcaacctccaccttctaggctcaagcgattctcctgcctcagcctcctgagtagctgaaattacaggtgccagccaccatgcccagctaatttttgtatttttattagagacgaggttttgccatgttggccaggccggtcttgaactcctgacctcaggtgatccacccatctttgcctcccaaagtgctgagatgacaggcatgagccactgagcccagctgaatatctttttttaaatcaataaccttatttcttagagcagttttaggttcacagcaaaattgagaggaaggtacagagatttctcatatatcccatgcctcccacacatgcatagcctcccccattattactattttccaccagagagtggtacatttgttacaactgatgaacttacattgacacattataatcattcaaagttcatagtttacatcaggcttcactcttgatgctgtacgttctgtgaatttggacaagtgtataatgacatgacatgtatctattactgtaatattatcgacagaacagtttcacagccctaaaaattctctgtgctatgcctgttcatctttccctttctccctagtaactcgtggcaaccattgatgtttactctgtcttcatagttttacttttttcagaagagtcacatagttggaataatacagtggatatctttttgaatagttaaaaaattaaagctccatggcagttgaatgtagtcatttaagatgttctttgtccttttgtttttcttttgcttctttatcattgtaaagaatgatatattctgatgacatatgctttacatacttagaaaacatgatttgtatagatatgtgcacataatagaaagggttgaggaaaaggacaccatgctgtaccacacagcacaaactggagcatcttgctctgtgaggtgggtccagatagattctctagcaatggaaggggacaagtgcaaggggttgtactttataaaactggaatcacaaagtctttcatacttaccttcggttggaaataagaccagacagtgaatgctataggtaagtacataggttcctcactgatcctcttcctttgagggatgaggttgacaacagcctgtattatgatgatgtgactcacctacaactagattctgtcatgagggatagcaagagagttttgctttctgtgaggtgaaaaagaatttttttcccctactagggagaagggcaagcactggaacattctggtagtaaaagggcattgatggttttctttctatatatttttcacatcatatagtactgtccagcagcctgccacacctccctggtgtttcttcagcttctctctgaatgtgaggtgtggttcctagcgtataagctcttaaaggagtgatctttccagtggtttttctgtgggaggtaaaatggcaggtgaatttgggccttgctatatgtagggcagagcaaatagctacaactaagtaaaccacccagcaccttccccaaagagtagtagccagagtaatacattgatctcttttgagctcttttccactagcggctggaaagtctttgcaaggattcctgtttctggtcggattcctatgttttgctgacatctggtgttagggtgttttattctaaactgagcagtttgaactgaagagctagagaggctgtgttgtgttataacaaaataagtgcagtagctcccccttaactgtgggagatacattccaagacccccaagtggatgcatgaaaccatgaatagtactgaatcacaaactgtttttccctatacatacatatctatgctaaagtttaatttataaattaaattgaatctgatgttaccagcagataaggtgtgagaattgaattgtgtcatcagcaggaatgattgcttgcttgttggtggggaaaaaccctccacacatttggtcacagaagccttctttgttgatgattgttgctgtggtgtgacagtagagaaaaatgtgtcaagtatgtctttctgcacgtatagtggataaggggtactactgtgtactctgttttaatggcgcctcatattttggtccagaaatcatgctctttgacactggtgactcatcacacctgttctgctaacaataccatttttactcaacctcatagggtttggctaagatgacttgcatactgcagttcacttgtagataccaaattttaataaatttattcttctttgcatctaataaatacaaagggaagagttcttactgcattaattacctaccaatatgtataacgaatgttaattctaataaggtcccaggcatgctcccaaaggaatgctttgtaacaaagcatcagtcttatgctttaaaaaaccaaaccaaaacaaaacaaaaacaacaacaacaaaaaacaggatctaaagcatacatacaagtgtgcacaatttttttatgaaggtagagtcttactatgtttcccaagctggtctcaaacttctgggctcctcaagtgatcctcctgcctcagcctcccaagtagtttggattagagggatgcatcactgtgcattcttatgcttttaatattctgtacatttgttattgatttaaaatgcattttacctttttctttaatagatgttggaagttctgatgaatctgcagtcaggtaggattttatagatttaaaaaattatgttaactaagaaaatatagatggaagaaacgaatatctgttgagtgttgtattctgggctagacatcctaatatgttctatgcgtttatcatctcataaagccatcacaacatctgtgttcctataacctactgtttattaaataaacaactatggattagagctgattaattgcctcatgatcccatagttaacaaagtagctggcctacagtttgaccatcagcctgcctgccttccaaatcctgtctcttgctcctcagcatagattgacagatatctgtgcagcccttggatcaaggtataggtctgaatcagattagtcagattgattaatttgattaatgtctaaattaatgagagtttaaataccttgaactctcatttaagtttatcattagaatgtggttagtccaagagtttgtcctaataaatttgacaatttcagtggtaaccagtatcttatttttaccatcaaaggctctagggcagatcttacttagctttgccataggggtgtaagttttacaaaagcaagtttaggcaagtcttagagacaaattatttgacttcccagtttggttttccatttaggcaagtatttctgcttacttccataatacattttttagtcttgttgctttttccgtgacttttctataatcttgccttcattttttaaaactttcttctctgcttttcttggtatttcttttgttctattattttttcaaactctgctggctatgtattctaagtttttctatagacagaatcaagaggacatagaattacagaattttaaggaatcttggaatgaattaaaataccttctagtatttttacctgtgttgaacattctggtcaaatgattctctagatagagaatgtgaggctcaaagagtttaggatgcttttttttagacataggaattggcagaaatgagatttgaactcatgttaaagcccagtactcttgcttctttttatatcctattggcgtgtgttttaataatacaaacgggagtgagtctgtgggtagaatgagaatggaattagctggggaacccaatggaagtagataagaatggaatgagcaggggaagtccaagtttgaagataaacaacactggattggataggagtacagactcttctataagagatcaaaatattggggtttatgacaagtttgataaagataaattataaaaatgaaggacacaagatgttgggaattatctacgaaggcacattaaaatagaaggttcaagggagctctaaaaagtttgctgcttttttttaaatcaaggactgacaaacttgaagatttttactgaaagatgctaaaacattttgagacactgggaggagcgtctgcagcagatagaaatgtggtgtcatctacttccatcctgacttagaaaggggtggcttagagcccctggagtactaaggggctggagattgctgaactacatagatctgtggcccagtacaggtgtctcctcacctctgcctcttttcccgattcactgatgtccttcccatgtccatgtgggctggttcaggggcatgattggctggcaaatcagtcatggagttcagttgggtagttggtagtgtgtctagctgggggcaggtgatggagactccagttagcttgtttttcaggagcagggatatagagagctcctagtcctggtcatttgaggccatcctttcaggaatctgtgctttcatagactgaagatttaaagattggagacttctgtggagccctgcagaagtggaatctggaagtgggagcccataggaagacagatacttagagagtacttagggaaatagaggtacacctaccaggactctgtttttttctgacagtctctctccttgggtgtctgagtgcctatgaaaagttttaagggcttgctagtttatgtggacctgaataaggtaggacctatagggtgaaaataatgggattttataattgttaatatttcaatctttctgggaaaagtattctcaataagaacatacacctttgttatttgacttctgtacatttagctttcatacatttcaaatattgtaggggctttcctgtactgatttagggcaaaggaaagcaataggaccttcctaagtgggttccatgctgaggaatcaagactgccatattgaagtgatgcagattagtcttttatccagagacagatcatggaaaagagacagtggatctttctaccttgttttaggttattagttttcttccagtttaggtaacaaaatttatgtcatccattaattgaattttaagttcagcttcaggacagataatttgtgagggcaaatcattgtcaggctctgccaatttattgactgtcactatttgttataaagctcaaggttagttttcattgaatattttatagatttagacaagtggaggcagaaataggtaactaaaatctatttttagaagaggacatattttaattatatcaagaatcactatttaatatatagattgctgacctttccctagattatggtttccttttttgagggggaagctggatataaactggcagttaaaaaaattgtaaagaaatcaacttgctcattttcgttgtgtgtttttgctctcaagcattttccatgaactgcgtgtggattcattgcctgcatcggatgacaaagacttgaatgttgctactaaggtaaagtggtctcttgtaaaattaattttctcactctgaatgtacttttgcatagtatttacttttcaaatttagcagtggtttacctatcattgttttatggtggtaatggaaagttggtcagagaaaaacatacatatggctagttgattcaaaaaatgtgtttaactttggtaactaacaaagattgataagtactgtgacagggtgggagctgaaaaaaaatgaactggaaaattagtagtgacaggaaaatcacattaggaaatgctttctccaatagaggaaatatgaaatttgcttaaggtttatttggataaatactaatactttgacttttaaatcatacgagtgtgactttcttaatatttatgcctgtataaatcttcagtggatcaaattatttgcagtaatcatgggatcctcctggtgatttttagtggcaagaatattcagcacatagcatatagcttttgttcttggaaacttattattttggtatcatattgtttttacgagagattgtttttctacttatattattggttctgtagtgagacaaaaaaaaaataaaaattgtagaaaaataactgagtgtggtggtgtacacctgtagtccctgctacttgggaatttgaggcaggaagattgcttgaacccaggagtttgagaacagcctgggcaacatcgtatctgatttaaaaatataaattgtggaaatatagaaatttaaatttatgttctcaaaatgtgtattgcaaaggaatttttgtgtggtttatgagttgtccatgaagagtttatataaggcacttcatctaattgaataacatgtattttgctgcaaataaccagttctagaagcagagactcttaataccaatggatggtaagactttatcctcataattttgtcattgtagtttatttaaaatatttacttcaccaggtgtggagactcacctgtaatcccagcagttttggaggccgaggtcggtagatcacctgaggtcaggagttcaagatcagcctggccaacgtggtgaaaccctgtctctaaaaaaaaccaaaaccaaaacaaaacaaaacaaaacaaaagcagaaaaattaaccaggcgtgatggtgcatgcctgtaaccccagctgctcaggaggccaaggtgggagaatcgcttgaacccgggaggcggaggttgcagtgagccaagatcgcaccattgcactccagcctgggtgacagagcaagactacatcttaaaaaataaaatagccactcaaagtcctcatatcatattctgaaattttgaatttcagaaggttttctatttagttgtttaaataatcattggaagctcctgcataccgtaagctactggaggtcagtaaacatatttgtgtgtatcctggagtacctagaatacagtcttccatgtaagaagcattttagttgttgttttttgagatggggtttcactctgtcccccaggctggagggcactggtgagatcttggctcactccaatctccatttcctgggctcaggtgatcctcacacctcagccatccaagtagtttaaacaatagagctatgtcaccatagacctgtgtcaccatgctcagctgagttttgtagagacagggttttgccttgttgcccaggctggtctttaactgttgggctcaagtgttctgcctgcctcagcctctcaaagtgctgggttacaggcataagacattcagccttaatagttgtttaatctgaataaatagacaaatgaatttttatataatggaatgttataagtaatataataaacctaatgtatctaataattaaatattgtatttaaaatattgcttacattgtattttttaatatttaagggtgtataagttttgatatgttatgttgagaaattatgccataattaaaaaggaaataaaatagaaataggtcatcagtagaaaatagggttacaatatattttctagtatcattcaactggaatcttaacattgagattttagattaacatttcttaagctttttattagctctaactcatgttctattaaatatacgttttcaagccatacattactctttattattcttatactgtaagttctagggtacatgtgcacaatgtgtgggtttgttacatgtgtatacacgtgccatgttggtgtgctgcacccattaactcatcatttacattaggtatatctcctaatgctatccctccccccttgtccgccccacgacaggccccagtgtgtgatgttccccatcctgtgtccaagtgttctcattgttcaatttccacctatgagtgagaacatgcagtgtttggttttttgtccttgcgatagtttgctcagaatgatggtttccagcttcatccatgtccctacaaaggacatgaactcatccttttttatggctgcatagtattccatggtgtatatgtgccacattgtcttaatccagtctatcattgatggacatttgggttggttccaagtctttgctattgtaaatagtgccgcaataaacatacgtgtgcatgtgtctttatagcagcatgacttataatcctttgggtatatacccagtaatgggatggctgggtcaaatggtatttctagttctagatccttgaggaatcaccatactgtcttcctcaaaggatgaactagtttacagtcccaccaacagtgtaaaagtactcctatttctccacatcctctccagcacctgtgggttcctgactttttaatgatcgtcattgtaactggtgtgagatggtatctcattgtggttttgatttgcatttctctgatggccagtgatgatgagcattttttcatgtgtctgccatacgttactctttagaattctggtgaccaatttttttctgggtggaaagttgattgaaagttctagttttctctctgtgttataataatgttctttcaggtagtggtcgatgaccatatttagctaattgaatgtcttatagtaataaactatatcacagaagtacttacaaaaaactaattgtagcataaatattaattagtattatcagggatatgaaagagcaaaaggctctgttatagatctatttccccatgtactttattgtacttcatgttgtctcttttctttcttggcttaagctcatatttcattgaccaattaggcttgttttttgtttgtatctctcttcattctcatattttaaattgaaatttttggggagtcagggtcttgctctgttgcccatgctgcagtgtagtggcatgatcttggctcactgcagtatccacctctcaggctcaagtgatcctcccacatcagcttcccaagcagctgggactacaggcgcacaccatcatgcctgactccttttggtattttttgagtagagatgtgttctcattatgttgcccaggctggtctcaaactcctgaactcaagcaatccacccaccttggccttgcaaagggctgagattacaggtgtgagccaccatgcctgggcaacattgagattgatttaaagaaattgattagggctgggtgtggtggtgcacactgcttatctcaacactttggggggcagaagtggaagatttacttgagctcaggagtttgagaccagcctgggcagtataatgaggccttgtctctgcaaagataacaataaaaacattagcatggcatgaagggacgcacctgtagttccagctattcaggaagttgaggtgggaagattgcttgaggtcaggagtttgagacaacagtgagccataatcaggcccctgcattctagccctgggttgacagagtgagacccagtttcataaaaagagattgataagaaactcttgatgcaactcattataattttaaaatggaaactaattcttgatattaccttagcagtgtgtccccgagaaagtgtcagagcctttacctggatcttcgcatgaaaaaggaaacagaatagtcaatggacaaggagaaggtgagaaccgtattttatttaaaaagtcttttgatggaggccgggtgcggtggctcacgcctgtaatcccagcactttgggaggccgaggcgggcggatcacgaggtcaggagatccagaccatcctggataacatggtgaaaccccatctctactaaaaatacaaaaaactagccaggtggtgttgtgggcgcctgtagtcccagctactcaggaggctgaggcaggagaatggcttgaacccgggaggcggagcttgcagtgagcggagataccaccactgcattccaccctgggcgacagagcgagactccgtctcagaaaaaacaaaacaaaaaaagtcatttgatggaatgtttctttgaaaatatgagcactaatagagtgtaatagctaaagaaagtgtcctattaactgtataataagtaaaggagaagtgaaatggtgataagttgtgtctctaaccaagggtcagcagttgattctattgggagtaccactaaaggagctgaattgtgagttccattttaagatactctaagacctgaggcaagtcaggagagagggaagaggaaatgaataaagagaaagaaagaatgaggagagcggattgtacatggaataaataaaaaagcatatgcagaggtaagtaagagaggatagtaaaggcaaattgatctgtagaagaaggaagaacatggtgttagaaacaggaaagaagataaagtgagcttccagtaccaaaatgtgtcagagaattacagtaacattttccttctcttgctgtcatcctcgctactggggaggcattaaggattgaggcacctcaccacacagacctgtgttttatctaccatagatgaacatcaccaaagatggtcagccatgtatggctataatttgtttttatagaaaatgttgtaacctcataggatagtatcatataggccaaattaacataattgaatagtgttgggtgatttatggagaagaaattaattcaagaagttattgcctgattaaaagttcattagaaacattatggcttataatgtagtattaaattgagggacataatagggaagaaattgaggctaggccaaaagggcaattaggggaaaccaatatggaagcacatcagtgtagaacagggcattcaaattgtcatgaatgagttgaagagcttctggaaggtgcacattctgattcagcaggtatgggagtctgcatttctcatgagtactcaggtgatttttggtgctggtccttggacacagctctgaatagcaagggaatagccttcctttagagaactctggaaaaagaaccattggagagcaatttaaaaaataacagaatccagggaaagcattaatttccttttatttctgagcatgattctagccacaggggaaggagaatgagatgaaaacagagagattacaggtgtatactactgctgaatacagatgaaaaaagtggtcacaattatccataaaaagcagttaggaagggaagcatcaggatgacagttctaaaaatcactgtttcaaaggaagagggattgtgaaaggacacggagggaggaaagaaagacatttgctggggtcttgggagttgaagccaagtaaacttgagacaactcacttccagttgcttcagcatatgcccagtctcacaaaagaggttattgctgtggagagtactggaggcaggagggagtgctagagttggggtaaaccacagcagctcatttcacttgataactgtcaggcctcagagagagaagtttcactgacatgagtgaataagatgtgattaagttgcatatagatgctttggctaattttttttgatattacaaaattcattctgtgaataccaaaattctctttttcaataaatactgcactgattttgaaatataaatatgtattcatatccagcaagtctgtggtaattcagtgttttcttttttgataaatattttgatatcggaagcttattcgacatggtttattttatgtgatccttgcatgagtggatcaaggagctctaactcaaggccaaatgaggggataggagaaatgtaggtgctgcagtagcccatgtgatca
